United States Patent 6,673,910 (NUCLEIC ACID AND AMINO ACID SEQUENCES RELATING TO M. CATARRHALIS FOR DIAGNOSTICS AND THERAPEUTICS) - sequence listing, part 2

SEQ ID NO: 3507 - protein, 690 aa, M.catarrhalis
QFFNGIFMTTSRKILVTSALPYANGPIHLGHLVEYIQTDIWVRAMKAMGHNVTYVCADDAHGTAIMLKAQDNGITPEEQIATVKASHEKDFAGFLIDFDNYHSTHSSENQYFSQKIYTTLKQNGYIFTKDVEQLFDTEKGLFLADRFVKGTCPECDAPNQYGDNCEVCSSTYNATELKNPYSTLSNSSPIIRSSKHYFFNLPQFDEFLRTWTKSQGRLQSSIYNKLSEWFDAGLAPWDISRDAPYFGFKIPDTPADEPDKYFYVWLDAPVGYMASFKNLCDRTDMDFDEYFNKDSQTELYHFIGKDIVYFHSLFWPAMLEGAGYRTPTAVNAHGFLTVNGEKMSKSRGTFIKAETYLTHLDPEYLRYYFASKLSANVEDINLDLEDFMQKVNSDLVGKVVNIASRSAGFIHKNHDGKLSDELTEPKLIDEIICAGDEIAAAYEAREFAKVTRLIMACADKANEYIDTQKPWALNKAGKFDEVQKVCTVSLNIFHKLIIYLAPILPKLSEQAREFLNIDSLEFDTRHRHLLSHHINPFTPLMQRIDKDKVNAMIHDSKENLTQTSGTDNTKKTVLDDTDTAKSAYIGIDEFAKVTMKVAHVVKCQSVEGADKLLQFTLDVGEEHTRNVFSGIAKFYQPEELTDKKVICVTNLAPRKMKFGISEGMILSAEKQGVLTVITLPDTMPIGAVLA

SEQ ID NO: 3508 - protein, 192 aa, M.catarrhalis
RGTNMHYINLIDDSGRFDFIHGDFLSMYADISRFIKITDEDYQTYLAYSTSPGELKYVEGKITYTPQDTDHIALKKAWQAWVWEDIKQKRHTNTHGGVYIKSVGKWFHNDDSSRTQYLALQVLPKLPDHLMWKTMDNEFVPMTKDLLNEIAMTMLTEEQADFANAEKHRLAMLESDNPLEYDYSDGWSAIYA

SEQ ID NO: 3509 - protein, 125 aa, M.catarrhalis
TVLKLNSCQGDAMKAKLIHSRLKIYRQSASRSATGAVKMNEWEHALTVWGRLIRLSDKDIIAGQAQSSQITARAIIRYRTDIDNTMRVQNGKQKYEIIGEPLADNNTGREYLTLMLKEVLDDRQN

SEQ ID NO: 3510 - protein, 151 aa, M.catarrhalis
HYPKLQTLTKWREFMHYPVTLTPDTDGFCVTFRDIPEAISQGDTIDEALEMAQDALMVAMEFYFEDNRAVPMPSQAQDGEHLVSLPPSVWAKVLLLNEMLCQNVSQAELAKRMGIIPQQVTRLVDLSHATKIDTLANAFAKLGKQLQVGLT

SEQ ID NO: 3511 - protein, 154 aa, M.catarrhalis
LMKKLLLSSAAVMMAITGCTTPSTVSVPANQAGVVVVPTAGTHHHGTQHQHGVYGQDITAVYQCDEGAKVVANYQPENDRAVLTVSAPTWHLHNQEIVMRPAVRASGIRFVNDTNPNSVYDWHAKGSEALLSVILGETDQEHTLHCRTDSPALM

SEQ ID NO: 3512 - protein, 209 aa, M.catarrhalis
CWKKITGQLYYRGLWFCLKLGLFLTFNPLGSYTGKIGIPFPSTDILLLDDEGNQVAQGEAGEIVAKGPQVMKGYWNQPEETARAMTADGYFRTGDIGVMDENGYFKIVDRKKDMILVSGFNVYPNEVEEVIASHSGVLECGVIGVPDEHSGEVVKAFIVKKDPELTEADIKTWAKQNLTGYKRPKKIAFLDELPKSNVGKILRKELRNL

SEQ ID NO: 3513 - protein, 486 aa, M.catarrhalis
CLENKTMSALRQTQSQLQLYDTLSASKRPFKPIHAGQIGIYVCGMTVYDYCHMGHARVMVGFDVIVRWLRAIGYQVNYVRNITDIDDKIIQRAYDNGETITELTDRFITAMHQDEQFLGCQSPNIEPRATEHIENMQHLIDVLLTKNLAYQGSGGDVYYAIEKFPNYGKLSKRHVDDMQAGASERVSTAEDKRHPFDFVLWKTAKPSEPHWQSPWGLGRPGWHIECSAMSTCCLGETFDIHGGGHDLQFPHHENEIAQSEGATGKTYANHWMHMGFINIDGEKMSKSLGNFFTIREVVDKFHPETIRFFLLSSHYRSPVNFSDTALKESHTALSRIYQSLKSAENFGVISIMPNAWESEAGQAFAKAMNDDFNTPKAVSVLFSVVTEINRAMKAGEYQKATQEASTLKTLASVLNIAQSSPHEFLQANIGNKPDGLSDAEIANKIAQRQQAKAQKNFAKADAIRDELNRQGIELEDGRMGTTWRRI

SEQ ID NO: 3514 - protein, 169 aa, M.catarrhalis
PCLNLITHLSMTTQTDGVLFMHRKVYLALYKGGADKFSYRFYDAVTRFFTRGQYSHCEIAVHIHNNIYHCYSSSIRNGGVRRKSMMLDDKWDLIKLDIDESQIRQFYGATEGSGYDLLGALGVVLGLRQHPHKYFCSEWCFEAITNKQDGWRFSPNDLYAIKSILTRRH

SEQ ID NO: 3515 - protein, 271 aa, M.catarrhalis
IILNFRCYEGNMLDQLIIGSRSFNSRLLVGTGKYKDLNETKDAIHASGANIVTVAIRRTNIGQNKDEPNLLDVISPNKYTILPNTAGCFDADSAVRTCMLARELLDGHNLVKLEVLGDEKNLYPNITETLKAAKVLIDDGFEVMVYTSDDPIVAKELESMGCVAIMPLGSLIGSGLGILNRHTLSLIIEQTKVPVLVDAGVGTASDAAIAMELGCDGVLMNTAIAHAKNPVMMASAMNHAVVAGREAFLAGRMPARHMAQASSPQTGYFFK

SEQ ID NO: 3516 - protein, 198 aa, M.catarrhalis
LQRKRPMSNLINFNFENRPVRVELKDGEPLFCLRDVADILDIQNVSQVATKQLDQKGVYKIYTLTDGGKQELTFINEPNLYRVIFRSNKKEAVKFQNWVFDEVLPTLRKTGSYTVAPVYPAVNVINAPAPSHGELYKTFIATVNLQGVMTMREMGDDEFVATYDDLPNLLRYRSWGVSDEKMAKIAKAALNKITGEWD

SEQ ID NO: 3517 - protein, 221 aa, M.catarrhalis
LPFDVPIINKNVYNIKYFINKKVYFLRNIIMKTIQLHGILAKKFGKSFNLAVGSTKEAMRALCVQLTGFEAFMMNAHKQGLRFAVFHDKHNVGESELDMNHTAKIIRVVPVVEGSKKEGVLETVIGAVLVVAGVVVTGMGFAPAGAALIGAGIGLMVGGISQMLMPKVDAQDNNQDGNKANKGFGGAVTTIAQGNPVPILYGEREIGGFIMSASQLPEDML

SEQ ID NO: 3518 - protein, 60 aa, M.catarrhalis
NLPENLSHSVIVRDDKGVIVYNDGFCQMSDEGYDSITKNFIGGDRGHCCLQVCHACSPAD

SEQ ID NO: 3519 - protein, 60 aa, M.catarrhalis
IINDGLNEPRFSHNITQDLAKLVGNYYETCQKSNFSQTHSSLRNWSCQFFSVCCCHCPDI

SEQ ID NO: 3520 - protein, 72 aa, M.catarrhalis
SICLLSRWSQVRILPGAPYACITMAAIAQLVEPRVVISVVVGSSPISRPIFQNPINKLLMGFLFVAIVEIIG

SEQ ID NO: 3521 - protein, 90 aa, M.catarrhalis
IIREIAMNEKQMLEFTKDIASPFAKELHARSLANVGTILYLSKKGIIDLNDYLNFMNELKEGLMQSDDYEQETKEAIQAEFDFYRERLIG

SEQ ID NO: 3522 - protein, 330 aa, M.catarrhalis
IWSFGSLKMHHTIARMQKFNKEFTNAKACYKKMQQAYLTSKNKFAFFPMQHVSLLDMSTAIAYEQTRSDPFSEKGVNALKTLNQLYLFGTWRYTLGIYCLDSEIIKDSKAIPNDTPTSIFLNLPEWCVYLDIDSTKIAITQDDKIKQIKGFWAVYDLIEYNSKPQKAINFIIDTDSDDDIYLPLTLILDDDMTVEQSLSYADNNIGDGGSNELIKILLPYLLWLCVAEPEIMHKGEPVSRANLDKPKYQTNKKTGVFIPPSEPFIYEVGSRLGGEIRHYQEQIEQGKHRQTSKKRPHIRRGHWHGHWHGTGQAKEFKIKWQPAIFVNAGV

SEQ ID NO: 3523 - protein, 112 aa, M.catarrhalis
LKVLAMITELKITEFTPTKDKVIWDVRDAEQYQEGHIEHAVNHPLSTIDKTLLDATKGDIYVLCGGGTKAQKAAKLINELDNDRRIIHLTGGTRGAIASGMAIISEQPLERN

SEQ ID NO: 3524 - protein, 82 aa, M.catarrhalis
AVICPCTLNALAILALVLATVAPVSVANDVTKAEFLAMMPSHTAPTIAAALTSVRKCSAAHKTALAMFWLIMLFWFMMSSMR

SEQ ID NO: 3525 - protein, 244 aa, M.catarrhalis
MSIRCIPAHELEHQLNDSEAKVLFIVENFAHTFEKVVNKGQIQQVIITGIGDMMRLKGLLINAVVRHVKKMVPNYCIPNKIKFKDILNKKYPYTKPSVGLDDIAVLQYTGGTTGVAKGAMLTHGNLIANVEQCTTYVKSGFEKSHQHGEYMAVALPLYHIFSFMVTMLGMKMGFALLLIPNARDLDDLTKQFGKYRPQFFPAVNTLFNALAHHDGFKSLDHSNLKVSLGGGMSVLPSTGDAGKK

SEQ ID NO: 3526 - protein, 61 aa, M.catarrhalis
IFIRNWYNRYRLSFNELKALAFINPKVEQYNHHNPISSAEFSHKIRENTPDSHIKSNKQAK

SEQ ID NO: 3527 - protein, 126 aa, M.catarrhalis
LNSLLSDWRHKMKLLNIKINEFAVTANTEAGDELYLQLPHTPDSQHSINHEPLDDDDFVKEVQEICDEYFGKGDRTLARLSYAGGQAYDSYTEEDGVYTTNTGDQFVEHSYADYYNVEVYCKADLV

SEQ ID NO: 3528 - protein, 378 aa, M.catarrhalis
GFIGFCVKICQIFIMVSNMLHRYTVFFVACALPLMFIGQVAPNMARELDFWLLWVAAMVLVGLPVLFAEFALSARSGDMPWQGMQKLTREADAGLVWRGFALLSVVISILIAANLSGQIAIRAYVHFGSVLQQSGIPIFGMAAGLMVIALILSLLKSRLLMVGVLLILLGSLLPIYDRVRSVPVMTEVGLLEWSRAVILALLCVGIGTGLYWFGGMATAPSLMTAKKSLAGYILPVWLTQLIFGSIAILAGSALVGVASFVVTSLGMLLVAAFLLYYAYTQLSTRFGILMAVAMVLLLAIVFSIIPANILLIIIICLSLVAVLMLSIFSGFVMKISHLRKTLNMSSELRYNTWRVFVRIIVPIAIIVAIIGLVLEWIV

SEQ ID NO: 3529 - protein, 233 aa, M.catarrhalis
EIIMKPAKKATLAKLTLASGIGLASFSAYAAVTVPTYDIEAGKAIVEANCAACHGLDGMSPVPTQPNLGGQNIKYLYKQLVDFKTKARRNGIMEAQLAGLTQQDLANLAGYYASRTPWTPGYGNKATVAEATKLYLGGDKTRGVIPCSGCHDPKGAGNAYAGFPRLGGQHAAYLATQLKLFRAAGREDDVSSDTEVRTNDSAKAGDKGMMQMVASRLSDRDIKILSEYLSALH

SEQ ID NO: 3530 - protein, 161 aa, M.catarrhalis
RRFLMIGKIEVLGLDELDKQFAKLDDKVKDKALSKALNQALNPIRKDAKFYASVAPEPHTMIVKGGRRVVVQRGLLRSAIRKRKVPKREMGELGGHGVAMGIYVGKGTKQKEYPNYWHFVEYGTSQMPAVPFLRPAFDKNVQVAVNAFAKTLKDEIDKIVK

SEQ ID NO: 3531 - protein, 118 aa, M.catarrhalis
KVYIMSKVATLATELLAGLSAINEPKKINIAEFDGDIYIRQISVGEQEQIAKHLEKEKGNNMALSFIFGVCDEKGNRLFSLDDLDSINQINFKAMLSVIKEINKLNGLDIDTEDHEKN

SEQ ID NO: 3532 - protein, 1179 aa, M.catarrhalis
EIIMAKVLSRLDILLHANTANYVREMKKATDKTKKELKSVADYGKLVGGQLGIAFATLGSAVSVSHIIATADQMQNLASQIRLATSSTEQFHAVQTELRAIANEQRSSFDAVVDLYSNSQRSLSALGKSQQDVINFTRNMTMAMNVGGRSAQAQAAALTQLGQALASGVLRGDEFNSVAEQAPILMDLIAKEMGVTSNAIRDLAKDGKITADVVYNAVAKATDSLSAMSAKMPTTVSQALQVIKNEYNYLIDDIMNQNSMMSQNIANAVLWAAEHFRTLVSAAAMVGAVWLGIIAKNSALVTSFATLTGATVASTKASIANAFSVQGQITAYNALSTRLVLLRLTKAHYIDLTKTAIAATAVYARSLVGLATSFDRTTLATKAATLASIGWTKTKRRAIGVGILATRTITGLGGAFMSLGRIITAHPILVLTAVIGAVIARTEGLSGAIESLGDAFSVSGVLAMDFVGGVVDGLGTAWTVTANYFDNLIGGSANATSFAQTAFGGFFAGTHKGFVGVLQITARVFDLAGASVVTFTQYAWKNISSLGTAITNVFKGIGNFIAFVLEGVINDVTAKINFVIDGVNTISGKVGGGTVALLGRVRIGRMNYGSTDFGFGGFTASVAKNNTHYLENQVVNAYDKVQSSAKQAHDANLGLAGSMADVAKGAGKASKELDDNYKSQLAEWERAKWDMSTPFISELSKIEFEITSVSGKFHRASDDMKNNLRKLAREMDIAKANFELQGTYTEAMRQIHLSNADGSKYLEMAYDLQDTANALHLADEEQKKQILSTLATLEAVTKDRELQKQTRDSRNELALLGVEEGMARELFAIEQQRTETLGQYNHLLKDGHTEQYKVIEMAVNALEQEQKKILVTKEYHSLVQSLKTDEEKRLDTLKSQLDVLTMHSQVMGANLDIERAKQLISQSVGLATPTNHYDELNAKTAGQYASLDTGLQALLDNERLTEEERIKIKEWGASERAKIEQAHSTAMNSLILSDSEDMFGSLASIAKDSLGEQSKAYRAMFAIEKGFAIARSIMAIQTALANASASGPFPANLGMMATVASQTANIISAIKSVVMPVGQAHDGIMSVPKSGTWNLEKGERVLPRHTAKALDDKLDKIGTGGRPVNIVINNYSGEKTDVQQMPNGDMMVTIGKMISHTVDAKLNQRFIQARRQGGELYGR

SEQ ID NO: 3533 - protein, 1627 aa, M.catarrhalis
EMTIHGAKKGGGKQRQPIIAPDSAQSKTFISIMYGLGEGEIAGLADGYKSVYLDDTPLQNDDGEFNFAGVKVDFRAGTNDQEYIDGFADVASETNVGVELKHGTPWVKSFNNLDLDALRVRIKWGALRQQNRENGDVVGVKIDYAIDVKTDNGGWVEALNTSINAKTSNAYERSHRIDLPDAQQGWAVRVRRITPDSTSELVSDTMYISAITEVIDLKLRYPNTALLGLRYDAEQFSNVAKMAARCRGLIIKVPTNYNPITRTYDGLWDGQFKMAYTNNPAWVYYDLCTAERYGLGSRLTQSMIDKWSLYRLAQYCDHMVDDGMGGQEPRFTVNVYIQSADGAFELLSRLAGVFRAISYWDGTSIVLDADIPQDSIYSFSRANVIDGIFEYTGTRARDRHTVAKVAWDNPANHFKTEYEYVRDEKAIAKFGVRVADIQAWGCTSKGQAQRAGLWALKSEQLETRMVTFKVGLDGYIPAPAKVIEISDELFAGRATGGRVLAINKTKTVITLDRAITAKAGDTLVINGDDGTSQRRQISGVNGDNVTVTKPFSDISEQNVWVLDSQDLATMKFRVLSVTADDNHEFTITAVQYNPVKYDAIDTGAVASERPISVINPTVQAPTKSVNLSSYHTVNQGVTVTTLVIGWEQVTGAVKYAVEWRKDNGNWQSLPPTGTNSIEITGVYAGQYEARVTAISAFGQASLATHSNLTQIQGKQGKPPRPINLSVQGVLFGMNLGWNFARGSGDTNFTEIEVSPDGRTHITTLGTFAYPTNKHEITGLQGNLRQFYRARIVDKLGNTSDWTDWVSGTTSADADKVLGILSGQISQSHLDQSLRTPIGKIGTIESNISKINVDLPELNQSIADAQSTLNTAVASIDTEKKRLSSAIVDINTLKQSNNAKTQEIANLTQTVSGHTSQVRELGVTTGDLSQKYSQVKTQANNATSEITAIKQTQGGQATSVERIRSELANKASIASINTLNQSLTTKERALSIRINTVESSVGGNSSSINTLNQSLTNKERALTTKQEQLTAQLANKASTASVNSLTESLASKERALSRRINTVESSVSGNTSSINTLNQSLTTKERALTTKQEQLTAQLANKASVASINTLNQSLATKERALTEQINRAKSEMGGRITQISDETRTLADANRTIGERINQLNSELAGADSISDNLLINSNRTLVTGAYLIATYRISETLANGDKVRLTVIADIGINRTGFMAYNSNSAGGSKLADITQSQSNSYTAEFEWNVGTGGNNELRLYHNASNTRSISTITSVSLQKITTGSGLASIKSSVANLERTLTTTNQSLAERINTVQTTLNGQTASIQQHAQSLNGLSAQWTLKVQSGGIVSGIGLASNNGVSDFAVLADKFYIASPQGDKKPMFSVITRPTTINGTTVPAVVSLNGDLIGSGTISGDKIRANTQITAPNIRGGSISIGSNFSVDSQGNLNANSGVFRGQVFADKITGQIDVESLKSSAVALGYDIFISPDGWYNNSPTQFDKAFKASYPSLGSIINGIGDQNYDVGSILYEIRVFCKRAITVKQKLYVVDDNLYCYINGRSAFGYYEDDYGYDVPRSYAGRRNEEISLSLQQGLNTIQYINNNSGKHSVHLVLIGDFIDNNIIKFA

SEQ ID NO: 3534 - protein, 121 aa, M.catarrhalis
DCQMNASQLIYEKLSALVNNQCYPLFIPEHNPNNPPYIIYQIISTEPDNTLDGMTGHEWANVQIDVYHNDYDDCLSLAAKAINQLDQIKPSIYHGVRYMRDNESGLFRAIIEYGFWQTLEF

SEQ ID NO: 3535 - protein, 196 aa, M.catarrhalis
RRQIIAMGMALKHLKLRNKAKIEDDLYRIFFYDCPPLEKKMHNPISGKALDLSKSDEAVFRRELHKELIKKRKFALRLGRLSDYNNGWRLKPRVLSELLKGKKAWGDLMDDDFTIDIMQKGVDMRIGVDISTVTLKMQANRIVLIAGDADFVPAAKLARREGVDFILDAMHQPISDDLFEHIDGLWTTYHTKRKQK

SEQ ID NO: 3536 - protein, 431 aa, M.catarrhalis
LCVMIKALSCIMMVFAKCQMKVMTQLPKILLAVTGGIAAYKSAMLARLLIKSGCQVRVMMTAGACEFITPLTFQALTGQAVHTKLLDETAERGMGHITLAKWADLVVVAPASANTIAKLAGGFADNLVTTVCLATDAPILIAPAMNQQMWANAIVQDNLKKLRQFGYHIMTPDSGEQACGDVGLGRLPEPEDLCQQILAFDKCRHIQPSLLGKTVVITAGATVEPIDPVRFLSNHSTGKMGYALANACYHAGADVILVSGKHVSLKTPFGVRRLDVGTAEQMLKVCLSVCQKADIFIAAAAVADFKAASVADHKIKKTKNQQTMTLQLIKNPDVLATICHTYPDLICVGFAAETQDANNCAKSKLAAKQLDMIAVNDVSDKTIGFGSENNAMTVFFAEQYDQMPQNLPKAHKSKIAEQLVACVVKIMNQKQ

SEQ ID NO: 3537 - protein, 91 aa, M.catarrhalis
KIYFFVDKILDIINIFVYNRHIKWQLRVIMKRKDLIGLLSEKGAVFKEGAKHTKVYLNGKQTTIPRHTEIKENVAKAIIKQLNANSQQTSD

SEQ ID NO: 3538 - protein, 282 aa, M.catarrhalis
TFAVWRLSCQQFDWLIGIKMKLTKQLKADIIAHAFDCYPAECCGLIVDKKYIPCTNKATDDEQFILCPKDFARAESMGQIQAIVHSHPDGGVLPSDLDKLQIELHGVPWVIVAVSKQDYGDEPAFGIYEPCGYRPPLLGRAYIHGVQDCYSLVRDYYSRELDIDLPDFHRRDGWWEHENHEPLYEQNFEKAGFVTVDKSVGNLQKHDVILCRVGRTHHVNHALIWLGDDGALKSETTPDCVGNALILHHPYGRQSVREIYGKGWADRTVMVVRHQALSQTNL

SEQ ID NO: 3539 - protein, 135 aa, M.catarrhalis
IKGFFRSKTMSETTLTELSRTEAQVLQSFIAQVDYWKNQHGDKAATIEVIYYPEDDGFEVANGEPNNGVLKRNRTTAFRADLLAWASNQLRQLQGWDNSQTVTEFSLSYKNDRYGVRAALASEAKADDAKAPNEA

SEQ ID NO: 3540 - protein, 71 aa, M.catarrhalis
KWGFILGDFMQITYLKDAPTGAVGETHDVPEPQARILIILGIAKPATSQSKADKPKRKTKTTTENSELDLS

SEQ ID NO: 3541 - protein, 68 aa, M.catarrhalis
MVGVEGFEPPTLCSQSRCATKLRYTPILSLQASLSARRCGAYNTTKAPSCQPLIYKINHKIYTLLILI

SEQ ID NO: 3542 - protein, 101 aa, M.catarrhalis
TLLLKATPSITTFWLYAQKPSNDRPWQDEVKAQIQFHQIGDQVTVKNVRNFEWISKTDYLPRWEVRRYDLSQIKSLDLIVSIWDNDNIAHTLLSFGLFVCR

SEQ ID NO: 3543 - protein, 65 aa, M.catarrhalis
LSVLMLEVLPLTELSTVLIRLDSARSLLAKLSVKLLTDAVLALFASWAVNCSCFVVNARSLFVKL

SEQ ID NO: 3544 - protein, 750 aa, M.catarrhalis
TLSFDRVFYLRLPMKTFTWKMNMGASASVHHAVSKTQFGDGYAQRVSLGINNQRTDWSGSKTGDWQTVILPIKTFLDEHKGVIPFLWTNPHGQTKKYVCENYEISQKKGNFWEISLKFEQSNSDSSSVPLLDFSNQNSGTSTPNLPQSALDDINKKIQDEIERSTQKDDAHDKAIQSLNTSKTSLSKSIDEIKEQLAGVSSVPMSVAWDSITGKPSSFNPSSHSHTISDISGLQSLLNAKANSNHSHSWNSITDKPQSFTPSSHTHQASDITDLHTILSKYATKDEIPRINTDGLTIDTSNLATKSSVNELSEQIATKADLSHTHTMSEVTDLSAELERYALKTELNDISVDTSHLATKSSVNELSEQIATKADLSHTHTMSEVTDLSAELERYALKTELNDISVDTSHLATKSSVNELSEQIATKADQSHRHTITEVSGLQGILNNKLNSNASARSAQKLTTPRRINGIAFDGTQDITLPTPTANVSWSAISNKPTNFTPSAHRHAISDITNLQRELDNKAPRNHSHTWNSITNKPANFTPSAHTHQWSNISNVPSATINNAGIVQLSNSTNGVRQTIAATEFALNEVRKLINSSSRRGSITGVLNRQSHRYFYQRRHGTSSTDAVYSDIDTFTFPDGRIVCLVRLEGIKPAFFDVNTASVGGSDHTPAKIINLPTAMPNKIISAIPQITSSSLGNTLSSCIVGWDWTYNIDPISGNTRSKSQVRIQFSGYQGNTTNNKIDLSIIVEGY

SEQ ID NO: 3545 - protein, 67 aa, M.catarrhalis
PFTTFKIPAGNKSSINSIKTKILTGVCSAGFNTMQLPAAKAGAIFHAAIKIGKFHGMICPTTPIGSW

SEQ ID NO: 3546 - protein, 674 aa, M.catarrhalis
IIFNFRYFRCHMSVLKNWIYSTALGVSIVGAVSVGVALPASANGLASLFGDTSQPKFLPVHEAFKVSSSQVGDELVVNFVVTPKHYVYQERLSLTLPEGVSSGSWKFDKTPTMIDDPNFGITPVFEENVTAKIKLSSQTGIQKQPVQIRWQGCAKAGLCYPPETTTVQISLNAHDGQVASASQTATKHDSATTQIAPHNQDASSQTAASAITQDEAVVQDFVKPDEQSLAQTQTPPVDENGEADTNQDIQINAVQKNRFALDHTLPTISDERISPILTIGLLFLAGILLAFTPCVYPMIPIVANIVARQHAKSDAKRGFALSLAYGVGVASAYGLLGALIAWFGQALGIATWLQRAEVLIGAALLFAIFAIFMLGWINIRLPSAISNQLSLKSQAADNRLGTMGGSYLSGLLSALVVSPCVSAPMAGALTVVAASGNVFFGFAALFALGMGISAPLVLLGTAQGKWMPKSGAWMQHIRTLGGFLLFGVSLLLIERVILNTWMLGLWMLWFIAVAAWLYLSVGRHQPLFKLLAIIPMIWAAILAYGITIGANDAWRPWHAQSQSLSAYQDIHAKTLTELDSVLVTHDKVLVDVTADWCIECRIMERTLFTDRPAVMNDYQVVKLDITETTDDSRAILSRYQLFGPPALLIYHQGKLERVLLGETKPETLKQALMP

SEQ ID NO: 3547 - protein, 405 aa, M.catarrhalis
QWPETWENGKPIRETLAADIPLAIDHFRYFAGCIRAQEGGISQIDEDTVAYHYHEPIGVVGQIIPWNFPILMAAWKIAPALAAGNCIVLKPAEQTPVSILVLIELIEDLLPAGILNVVNGYGPDVGELLATNPRIGKVAFTGSTEVGQKIMEYATENIIPATLELGGKSPNVFFADVMDKDDEFLDKALEGFTMFALNQGEVCTCPSRALVHESIAEEFLKKAVERVKKIKTGHPLYTETMVGAQASQEQQDKILGYIDKGKSEGAKMLTGGEVRYDVDGGYYIEPTVFKGENSMEIFRDEIFGPVLAVTTFKDFDEAIKIANDTMYGLGAGVWTRDGSTAYRAGRAIQAGRVWTNCYHIYPAHAAFGGYKKSGIGRENHKMMLEHYQLTKNLLVSCSPKAMGLF

SEQ ID NO: 3548 - protein, 512 aa, M.catarrhalis
NFNSNYFEVSTLLMKADMSAQLGTWSARSGFIFAAIGSAVGLGNIWRFPYVSYENGGGAFFLPYLIALATAGFPLLFLDYVMGQKYKGAPPTAYRRFIKSAEGIGWWQVAVCTIIGIYYASVLSWAGNYTLFAVGQQWGEDTEGFFFNTYLQNASELTMAYSSQLLIGLVVVWVMVLLILYGGIKKGVELSNKIFIPLLIVMFGVLVARAVTLPGATVGLDTFFAPNWEKMADPKVWLAAYGHVFFSMSIGFGIMVTYASYLKRNANLTGSGLVVGFANSSFELLAGIGIFSVLGFMAQASGVPVSEVVSGGIGLAFIAFPKIISTMGDAGNLVGILFFGSLFIAGVTSMVSILQVPISAVQDKFGWSKNQSVTVVGLGSAIISITLFGSQNAITFVDVIDNFVNNIGIVFGAILSIIWVTWFNRNKLRGLINHINAISSVKVGAIWSFMLTIVTPIALIVTLGLTLKSLLTEGYGGYPANVQLIFGWGVIIICAILALILPRINGHSSHEK

SEQ ID NO: 3549 - protein, 411 aa, M.catarrhalis
RLWMWVVAFLGAATAYTESTLAQIYKENDRGQYRGGPAYYFEKFFGGGFGKFYGILVAISFIISCGLFLPGVQSNGVVKAITGITGEGTMVNTAFGAVGTNTLVVTLVMVLILGLIIFGGIKRIARVAEFVVPLMALGYILMAVLIVLFNINQLPNIISLIVGDAFTAQAGLGAAIGWGVKRGVYSNEAGQGTGPHHAGAAEVEHPAQQGMVQAFSVYVDTLFVCSATAFMILMTGMYNIQGTLPEGQFLVQNVDAATIISGPAFTQMAVSSIFGSFGNTFVAVAVFFFSFTTIMAYYYIAEVNVAYLTRSIKTTGALFFIKLVLIFAVAYGAINNSGYIWNMGDVGVGLTAWLNIVGILAIFFMAKPAILALKDYEAQQKAGVTKFTFDPIKLGIKNATFWEERNKKEQN

SEQ ID NO: 3550 - protein, 387 aa, M.catarrhalis
TGGVIMLYDLFDYQLLKLVWWLIVGILLIGFAIMDGHDIGVCTLLPFVGRSDIERRIIINTVAPHWEGNQVWFVTAGGAIFAALPLVYATAFSGYYWALIAALWALFFRPVGFKYRSMIKNDRWRHTWDWLLFIGSAVPALIFGVTFGNLLLGSPFHFDQNLVSTYSGSFIELLTPFALLCGVVSVAMLTMQGGVYLAHRTTESIQSYAKTATNVAALATSLLFAIAGFWVQSLDGYLLVGDIDGGAVIDPLSKQVQIQSGAWLTNFYDYPWLWLLPALGVLMPVMVIILLKIERTLLAFIASSLAVLGIIATTGAALFPFYMPSSTDPRSSLTVWDATSSHFTLLVMLFVVVILLPLVLTYTSWAYAVMRGKVTKAYIKENEKTLY

SEQ ID NO: 3551 - protein, 480 aa, M.catarrhalis
QLLLYLGDFGMITEHLVDISRLQFATTALFHFLFVPLTLGMTWLLVIMEAVYLITGKQIWKDMTRFWGKLFGINFVLGVTTGITMEFQFGTNWAYYSHYVGDVFGAPLVIEGLMAFFLESTMVGLFFFGWDKMSRLQHFTTTLLMALGTSLSALWILVANGWMQNPVGAEFNYDTMRMEMVSFAEIFLNPDAQNKFVHTVSAGYVTGASFVLGISAWYLLKGRDVALAKRSFHVAAAFGFAAICSAIVLGDESGYSIGQAQQTKLATMEAMWETEPAPAGFNLIADINEAEQKNNWSLHIPYVMGVIGTRSIDTEILGIQDIKKLNADRIINGVTAVSALDLMRQNKLNGIKNPQALIDIFEEHKKDLGFGLLLKKYTDDMAKITPQMLSKAVDDSIPRVTPMFWSFRLMVGMGVLMLILYGLCLFFSLKGSFIHKPWLLKFAMIMIPAPWIAIEAGWFVAEYGRQPWTAYGFLPTHLSV

SEQ ID NO: 3552 - protein, 82 aa, M.catarrhalis
GLALYELAKPTPSKFQKVCLIWQSLPVPVIAVVQGVCVDAGLQLALGADIRIAAMDACLSVLETKWGLVADMGITHTACDIR

SEQ ID NO: 3553 - protein, 239 aa, M.catarrhalis
SAAPTVQTRPEAIEAARKAEEAKKAAEMLKNSEQETKDEKAKTADKPTENKAENKKENKNTQTKAPVKAGTHDVQRGETWQGIANRYGISVAALVEANGVTRNDILRAERRIKIPSASQIARLERDNKARESASKDGNKKSDNQPQSKTDKKTESKSQSSQTSERYMVQVAISPDKDRVDEVVKKYRDAGYKVTTSNTSRGLRILVGNEKTEEEAKALRTKIAADSRVPSSGAFVHKAQ

SEQ ID NO: 3554 - protein, 160 aa, M.catarrhalis
LCQPLGDEVYPKYKTWCDEYFYLKHRHERRGVGGLFYDDMNTASTNWDFMTCFKFMQAVGQGYLDGIIPIFEHNKHQSYTEHERQFQLYRRGRYVEYNLVFDRGTLFGLQSNGRTESILVSMPPLAAWEYRYEPKQGTPEFELTDFYLKPQDWLNLSDKP

SEQ ID NO: 3555 - protein, 158 aa, M.catarrhalis
QNGAAAMFHKITLAAACFMTVILAGCNSSGTATANNPQVEDRAKLMKDWRHANEGMKAMIEDPSRFDAITFKERADFIADTNATMWVHFEGEMAQGGHAKDEIWTDPEGFQTKIEAFTSSINALALAASEAASAADVEASYGEMASQCGSCHKAYKKK

SEQ ID NO: 3556 - protein, 405 aa, M.catarrhalis
IKNLASKDFLMNKMLPNLADRAIFNLGFRIFFASAAVYAVISMVLWLFVYRGGVFSAHMSIAPQYWHGHEMVFGYSMAVVAGFLLTAVGNWTGKTMPSGQQLYLIWLPWLFARIIFIVLPQFLWLGVLADIVFTILFLISITKPVIKTKQWRQMGILSKIILMLIANLFCLAATLGWHIGWYYALYLGVFVIIGLVLTIGRRVTPFFISRGVGYAFEPRNNHYIDRISLISFVIFFLLEVFASQQLLASLCALVCALVQAWRLQGWYTRGIWKKPLLWSMFISMACIVFGQLMYFLRIFQFGITNSLAMHMMAVGGIGILSLSMMARVSLGHSGRSIHQPPKTVPWAISLLSVATVFRVILPWLMPQHLVIWIIHTQILWLIAFFLLSVSYMNIWRTPRIDGRAG

SEQ ID NO: 3557 - protein, 710 aa, M.catarrhalis
NMNFLIIGSETVMTDSATYRQPYTAKVFDEILTMRPDTPILDCIASPDDLKALTNDQLIQLADELRAYLLYSTGVSGGHFGANLGVVELTIALHAVLNTPYDKLVWDVGHQAYAHKVLTGRRERLPSIRSKDGLTAFPEREESQYDTFGVGHSSTSISAALGMSLAARLLGENRTVAAVIGDGAMTGGMAFEAMNDAVQQNADLLVVLNDNDMSISAAIGGFSRHLAKLWQRGLAMDIDKHGNILMVKRTISSDDRRIRHYLHMANGAFEDVSSRLPSKISEKISELFHGVTSSPLPDKIAEKIGDKLFADNLFKAIGFTYLGPYDGHDLPKLIQVLERAKQLKGAILIHVHTIKGKGFLPAEADPIGYHAIGKLPKAGKNQAPTSAPTAKKYSQIFGDWLLHWANIDERLVAITPAMAEGSGMVEYATKYPKRFFDVAIAEQHAVTLAAGMATSGKIKPVVAIYSTFLQRGYDQLIHDVALQNLDVTFAIDRAGLVGEDGATHAGVFDLAFLRCVPNVIIAAPSDEHECHQLLNTCYQYDGVAAVRYPRGVGVGRKVDMTDEHYPIGRANVVWQSSNFDTKSTKKLAVLSFGTRLKDALTAAQRLSESQAIACIVVDMRWVKPLDEALILRLLEMGVTHIATVEEHQITGGAGSAVNEFIVSLQALVKLLNIGIKDAFIHHASHEEQLLYCRLDTDGIYQSLSNLIIKN

SEQ ID NO: 3558 - protein, 104 aa, M.catarrhalis
DVMQQIAMTAEMMGAPIAKDYGLLTHISDDPVCMAISLIDAIKMRSPDVVLASKRVMNTTQRQDYLALYQEKLWQIKLMLGANRKLAIKKAKDSTVQFIQRQFE

SEQ ID NO: 3559 - protein, 171 aa, M.catarrhalis
FEPKTLIQQEHLMQAQIQAVRDFLLNLQQAIVHALENQENSGGFDGRTDTKFIADTWERPEGGGGRSCVLSGGQVIEKAGVMFSHIHIKQMPASATVRHPELVGAQAQALGVSLVVHPKNPYVPTSHANVRLFVATPTDGSAPIWWFGGGFDLTPFYPNLNDVKHWHQVAY

SEQ ID NO: 3560 - protein, 103 aa, M.catarrhalis
LKICLSNPPNEFLKHPHFYQKVQQVFNKTVTQHFTQHKMDALIEFYSSPIGKSIHKNQMAFNRDLINSLSNIVMEMDELGTPKEELEAIYDKLFPQLHQIFEK

SEQ ID NO: 3561 - protein, 126 aa, M.catarrhalis
SRCSMEPMVVMAANAAKKVGHEILRAHQNRHRLDLAVESKGLDGLVTQIDRYAEELTIATLKESYPNHSYLGEEFGLQEGKGHDADWCWVIDPLDGTQNFVHGVPHFCVSIAVQKNGVTEHGVIYD

SEQ ID NO: 3562 - protein, 209 aa, M.catarrhalis
KCLRYFPLYKFITKAKLPTIHGEFDIHIFENDDGQEHILLSTGLPNHTDKLLLIRIHSECLTGDAFGSLKCDCGPQLNAAMSAIQSHGVGAILYLRQEGRGIGLTNKIRAYALQDQGHDTLEANLLLGLPADARTYEMCQAMLAHVGINQVALMTNNPNKVNELNELGITVVERIPLIVGINQHNTSYLTVKGERMNHYINTDDLSQKP

SEQ ID NO: 3563 - protein, 149 aa, M.catarrhalis
QVGGLVMISKQIVLGITLVIGSGVAFFALAKNDTQTTKSVQTPQQIPSDTKVAKPVVQPLTADVATEEKLLAEKQRVREAHTLQMQKQAAALLEDQNNARKQALEKASSEANGRMTNDTQAVSADSAAKSELICSTNSSDTPRSNRSCP

SEQ ID NO: 3564 - protein, 464 aa, M.catarrhalis
VIFVLKAHQTKYNSLKYLGIIIMTRTLSQWLEYIGGIHVSAIDMGLERVLPVASYLGIIPIKTQQDQTDKKPIIFTVAGTNGKGSTTKTIAAICEACGLKTALYQSPHLVSFTERICINGNEISESDLVAAFEAVENARVAKNVTLSFFEMTTLAAFWHFNQKKCDVWVLEIGLGGRLDVVNIINPDVAVITNIGIDHVDWLGDDIECIGQEKAGIIRENIPVILGARQLPNSVHELANRLTKHVHQLGVNYDYMEQDETWIFSNAALTIQLPKPKLSLQNAVNAVAAVLESGIKIHLDSVIDGLHQVQLAGRFDQRIINDRHWIFDVAHNSHGISFFLAQWADEWHKHKKIYPDAKLKVIFSMLGDKDVDAVLEVIKAALDDKKISIHDWSVAAINHPRAMDLQTLLGHVHTHIQPSNLKIYQDLAQAAQSVSTDASTQDLIVVFGSFHTISETLVALLGRPY

SEQ ID NO: 3565 - protein, 217 aa, M.catarrhalis
LFRLEKLMSKGQTLQDPFLNALRKDRIPVSIFLVNGIKLQGQIESFDQYVVLLKNTVSQMVYKHAISTVVPTRNPRTEGGSTPAQSAGGYQGANLGVMSSGTYQGGGFERQTQRGFDRGGMGYQSSSRPQGGFTRTSQTGFERQTQGGFDRGGMGYQGGGMNHTGFERQNFDRSGFEAQGFDGKAFESNDTKNFNRSGFDAKPDPKFNYDDDFENQS

SEQ ID NO: 3566 - protein, 401 aa, M.catarrhalis
QPISVGLSITSYLIFITLDYNLSHHMSYSIFCQTKNNVLLEPMFFGQPVNVSRYDQQKHPIFEQLIEKQLSFFWRPEEIDVSKDRIDFAELSTHEQHIFLSNLKYQTLLDSIQGRSPNVVLLPLVSIPELETWIETWSFSETIHSRSYTHIIRNVVNDPSKIFEDIVDNEYILERASDIAKYYDDLHLCAKLYDLHGEGIYQIDGQSVEVTLPKLKKQLYLCIVAVNVLEAIRFYVSFACSFAFAERKVMEGNAKIIKMIARDEALHLNGTQHMINLMRQGRDDPDMVAIAEACQEEAIEIFKSAAEQEKAWANYLFKDGSMIGLNRDILCQYIEFITNTRMSAIGLPAIFETKTNPIPWINAWLSSDNVQVAPQETEITTYLVGQIDSDLDDVDLDDFEL

SEQ ID NO: 3567 - protein, 132 aa, M.catarrhalis
FGVSFLKLYPMKCHMNNNQNAVVLFSGGLDSTTCLYWAKSQFKTVTAVSFCYGQRHSSELHAAQNIAKKLSVRHHVIDIDIAKLGGSALTDMNLSVPNHDESVTYSDADQVAPITYVPARNTIFLSYALASC

SEQ ID NO: 3568 - protein, 153 aa, M.catarrhalis
PAESNADASTSAQTCSGRAVLSTIIAFIPPVSAMSTGLSSRAASSLLICLATSVEPVKITPLMRSSDVKAAPTSPAPKTSCKASFGTPDSCSQDTAKCAIKLVCSAGLATTVLPVTSAETTSPTKIARGKFHGLIATTVPTGLDRLSDSASSA

SEQ ID NO: 3569 - protein, 107 aa, M.catarrhalis
  UNSURE (64),(68),(77),(78),(79): Identity of amino acid sequences at the above locations are unknown.
LVNPRACNSATANASPKASVAVVLEVGASPRGHASSDRPKVSAMSADLGKIPRLSRLMLISGMXSVFXRRRNRTRVXXXSPEFEMAMSTSPCTRRFPNHRALPLQGA

SEQ ID NO: 3570 - protein, 185 aa, M.catarrhalis
RIAFRHSQVIATDNPMNVIDIIISIVVLLGIWRGFTVGMIKSMAMLLSWFIALVVASKTANSFSHIFAPWIDNPVLQVAMAFIVIMLITVLLVGTVASLLSRSFKALKLGFLDRIGGSVFGAATGMLKVLIVLSIISPILMLTPAAQSSVLVPSLLPYAPMAKNFLHKAFDSTWNQLENPYKNQR

SEQ ID NO: 3571 - protein, 489 aa, M.catarrhalis
SMDTDMKHLTKHRLSAAIIGVLLFISPSVQANTTHHHTLTSSELKLADDSIIDSINQLGELTVNIPNTQYFQTNNGVSVAFTPLHELPIVDISLYFNAGSAYDHQVGKSGTANMVATMLTQGTDSLSEDEFVAAKERLGIDFTSTANKDNLTLSLRSLSDQSLLNQAADLMVDAVTQPAFDDKTLQRNKNQLITSLKQKKQNPYHVASVAYHQAVYENHPYAHATTGDEDSIAKIDRDELLNFWHTFINANNATLVITGDMTAKQAKSLANHLTAKLPTGKSYKNTLDLTKPVKARHIHIPHNSSQTQIIIGHPTSKVRTDKAGRQEFSDFSLGNEILAGGDFNARLMKTIREQKGYTYGIYGGMERLRAGGNYVVEFSTDGDKAADAILETLHIINESLNEGITQEELELVRLGNKNGFANIFSSNASIHRVIGALFVADYPKDHLNHTLNRLDNATINSVNTALNSRIKPDEFIIITVGKTKPNLGK

SEQ ID NO: 3572 - protein, 513 aa, M.catarrhalis
FGVTMCGVIGVMAHEPVNQILYDGLTMLQHRGQDAAGIVTLKDNRLYLRKDNGMVRDVFLNQHMTRLVGNCGIGHVRYPTAGTSSTAEAQPLYVNSPYGIALAHNGNLTNAEKLARELYEEDRRHLNTQSDSEVLLNIFAHELQKFTKPALESDDIFEALTKLYKRCQGAFGVVALITGHGLVAFRDPNGIRPLVYGRRLTEKGIEYMVASESVALQALGFEIVRDIAPGEAIFIDLNHSIHTHQCVPIEKGQYTPCIFEYVYFARPDSIIDNISVHKARMRMGEKLADQILREWGEDHGIDVVIPIPDTSRNSALELAVRLNVKYREGFNKNRYIGRTFIMPGQQQRKKSVRQKLNAVPLEFKNKNVLLVDDSIVRGTTCYEIIQMARDAGAKKVFFASAAPPVMYPNVYGIDMPVRGELISSGRSVEEVCEIIGADRLIFQDLGDLIEAVKDTKHSQVDGFDCSVFDGKYIAGDIDEVYLTDLQNKRNDAVKDKGVTIVDTPVDMTGVSAV

SEQ ID NO: 3573 - protein, 220 aa, M.catarrhalis
KLVTYALRIFMKPITFKDGSPAPVNNIYCIGRSYAEHISELGNTPTGEPLVFLKPTTALTTDNTLRLPGYSEDIHHEVELVVYIDQDVADDQIPDLSCIAGYGIGLDLTARDIQNALKTKGMPWTTAKGFRHAAWLSVLTKGIPTTHQLSLMVNGDIRQDDSTDKLLFDITYQLNFLHEKFGLRQGDIIYTGTPKGVGRLVSGDTLVAKLDTESYTIHIV

SEQ ID NO: 3574 - protein, 108 aa, M.catarrhalis
DRGAIVKGTVKEVDAKGAVITLADEVEGYLRVADIARERTEDASKVLSVGDEVEAKIVGVDRKSRNISLSIKAKDEADERQAIKELSNTAAETQPKTLGDIFGEQLKG

SEQ ID NO: 3575 - protein, 458 aa, M.catarrhalis
RSHAKITDDFFRTSLAIFQIFVTISTNVKQILGGMMKILVLGTGGREHALAWACAKDDAVKIVYVARGNAGTAIEPKLQNVDLDITDHNALIAFCQTHDIQFVVVGPEAPLVAGVVDDLRQAGIAVWGPTKYCAQLEGSKAFAKEFMQKYGIPTAYYQVFTEIEAAKRYVREKGTPIVIKADGLAAGKGVIVAMDEATAFDAIDDMLDGNKFGDAGSRVVIEQFLSGEEASFICMIDGENILPMATSQDHKRIFEGDTGANTGGMGAYSPAPVVTQMVHDKVIERVIRPVVEVMKANGTPYTGFLYAGLMIDEHNDPYVIEFNCRFGDPETQPIMMRLKSSLTCLIQAGLLGNLPNEAQWLDQVALGVVLASRGYPESSIKGDIITGLDTQTDRLKIFHAGTKQSGDAIVTDGGRVLCVTALADDIQTAQKDALAAIERIYFDGMQYRRDIGWRAIKR

SEQ ID NO: 3576 - protein, 292 aa, M.catarrhalis
CSMACQGVIMTANIWIVQGDGILCTSDGLPFVLKLSNVPTKAIHLGFAETHHKQSLLLCSPNQLPISHAMDINDAIKLGLIFAYGDGYDTKTVRNLKIVSFREFLTVMDNKMLNLMARAIMLIGWHNDHQFCSRCGAKTTHHPQGEHAKICPKCRHHAYPRVQPCIIVAITRIHPKTHKQQILLARHHHHKSGIYGLIAGFVEVGETLSMAVHREVYEEVGLLIDDIRYFDSQPWPHPSNLMVGFIANYKEGQINIQRNELVDAQFFDIDQLPPIPNQGTIACSLIQAVVTA

SEQ ID NO: 3577 - protein, 60 aa, M.catarrhalis
PKYYNDNHHQKHNTKAKCHRLSTLSNKCLSNENFVKQKLLNLCHKSVMNQSLICHACLLR

SEQ ID NO: 3578 - protein, 68 aa, M.catarrhalis
PALLIGFYLTLIVQLSCGKTSHLFRFRSYPYLHFMILFNDFDCSINLPKIHYTKTLKPYHNMLGDRWY

SEQ ID NO: 3579 - protein, 273 aa, M.catarrhalis
AKGYYMNTYTPPEVWDYQSIKAKNGGTFGGTNRPTAGATHEQKLPVGDSPYQLYSLNTPNGIKVNILLQELKQLGAITGYDAYKINIMAGDQFGSDFVKINPNSKIPALLDQSTTPATRIFESGAILLYLAQKHNAFIPTNLNQLSELYSWLMWQMGSAPFVGGGFGHFYAYAPEPMEYPINRYAMETKRQLDVLDQHLANHTFMIKDDYTIADMAIYPWYGRLCLGELYVSDSYDAAKFLEVHTYQNVIRWAKAIAAREAVQYAQSLELKVI

SEQ ID NO: 3580 - protein, 1383 aa, M.catarrhalis
PSYLDNMFTITQSNDTQILLDHLIHYYQQTQVQRQGEELGVSVFTPFIVIVPSMVLGDWLNRSIAERLGISTLFMTQFWGQYQWQLIQQVLRIDANHHPSDALQVPEVAVLSGSVMRWRIFGFIKTLSNEQIIKIMQDDHHPLYDFLMTIYDTQNQSIPEHRLWRICEEVSSVFVRYLTHRPEWLHAWTHDLPLPESIDEMIDTKDRFANDYSDSDPTPKWLIQQYHDLEKLLRYLWRQLFSEVYAYRETLEVRFWAVLDGLRGESVAAEAYKSLPNHLYLFTIQQIPLLELQFLKRLSVHLNVHLLHFNPSKMFWADIVDKNWLATQRIINPNLVYLKDYGHVLLSRLGKESRETFAMLADMSGGDYYYEKEGVNRRFYETYRTPKDWQVDWQDDFVSPAQESKSLLNQLKSDILMLEDGEATKQWWQQELVSAFKNSAFWEQKVKTKSQLMLPLGLDKNDQSLRLPSLSIHACHSLKRQLEVARMIIARYLNEPNSDGSCRKLSDIVVYLPEAQAAEDLIRLIFNDDVGMDGLKLPAKITGTASREVDSLMAAISGFYRLLGAKNARFYRDDVYEWLMTPALYESLGLDFESVNRACQLLDAAGFRRGFDAAHLAMTLNEADLDYRYSFSYALDRIVAGFLTPCDSPSPSSLMHPFKWRDESFQEASLPLEGVTLADQPIVEALCLIHAGLREFRDEYQRLAPVIDWLHHIEHRVINRYFTKYRETSQMHVIFKVMNGIAASIRANHHYHHHTKNSTQGTQNIELTLEFVLESMASLLSSQAVSAEPAGTITFARFGALRNVPFGLTLMLDMNLSAFPRQDRQARLDLMKAGLKRRGDRFLEDDDNGAFLDAILCSRDACAIFYTNVADDGTQLLPASPVSELIEFFKSNVDWAVDLQADHTNQADQIHAKLATIAPKLVQQLLIYEHAANAFDASVFYETKEMVCDEDDLADFLTQKILHAKQSQTYYLPPSPMMVKLRHLLDQDFNQSPIISLPDATIYQMLAEALQNNLQGDSGQLEEVLTIFGIQLPNSMPLNQIYHTLKNPATAYLKHKLPLLYDAEDGFLEEPLSLDGLGQYQLKETLIDAMAQGVFDGMPMDEFDYHKLIDTIYMNDDKASEFAHIVRIYYDNLLPAGANRLTSLDNLVGQLAKLTDDFAQNLTDLQVKKQQLQYSSMISPTKEQYIAVELNHIPLDIVAKLPISCDQWLRVLPNTVRAGHFLRFYLHHLAWQVSRQTDQKDIEQNLGSSLWQFGQASNDLKDFHLNDVSLLKLKPIHKETAKRQLQNFMVMGLLAKQMPLVLPLMTSLNIVALNTKNELEFGESQFNDWLSGQYEDHYQGQSWQKILDGLQPLPEIKKGKELAQVLYAGLLDALIIDPTSQTV

SEQ ID NO: 3581 - protein, 87 aa, M.catarrhalis
PCYQKIRTQNPAYKAQKANAIDTFLLYSDTYRHFMMLFHIYQLKKHLSKRILYEHLYTARSLGLSKYQSQKRRHIWRYKSPHSRGNA

SEQ ID NO: 3582 - protein, 150 aa, M.catarrhalis
NHPQGRCMSKQAYANAIVIALGSNHDAKVAFTCAIKSLQELGRVVLSQRICGQDFTGRSQRIYHNACAYIILTKTMQYTDIEQTLKQIERRCGRNPAKKCTKYDYEVVIDLDILAARFDEQWQMNLARLPLKNHDIQGIKQVAAFLLDQI

SEQ ID NO: 3583 - protein, 114 aa, M.catarrhalis
ISHNKKNKDCDMGWVFTDETRFYLHENETLLDGMIRTEHKKVHYECRQGYCGTCRMKVLATTGSITLVKKPLATLADDEILACCCTLNGTTKVSYYPKNENQLPLFIDCAEYLP

SEQ ID NO: 3584 - protein, 410 aa, M.catarrhalis
YACKRVGCMKPKIAVIGAGAAGLMAAEVLSLYPVSVDVYEHKPTAARKILMAGKTGLNISHSEPFETFVDRYTPNDWLTGYLQSFHADHIVAWMASLGIESYIGSSGRIFPVEMKASKLVRAWLSRLNGRGVRFYYRHRCTQISGRVLSFDKLDAKAELIDSFCANYDAVILACGGGSYRALGSDGAWQQWFDKDLLTPLYASNVGVLVDWSSFMVPLFGQPLKRIQISVGKKSYQGDVIISHYGLESGLIYRLNRAMRCCQKENGFHLSVDLMPDKSVDTIHHILSQTKRKSLNTLLKKAGLDAVKISILRECTPKADWSDTAKMAVHIKNLTIQATGFRPIDEAISTGGGIKRIALGNDLQLIKESGVFCAGEMLDWDAPTGGYLLTACMATGRAAAYGALQFLNIDQ

SEQ ID NO: 3585 - protein, 318 aa, M.catarrhalis
NVGKDMSENEKGGWFSRMKAGLSKSSKNLSEGLVNVLVGGKQIDDELLEEVEDQLLVADIGVNATNRIIKNLTEQAARGDLIYSHALYKALKTELTDILTPKVAPLIIDTTKKPYVILMVGVNGVGKTTTIGKLAKRLQNEGKSVMLAAGDTFRAAATEQLQIWGERNGIAVIAQGHGSDSASVIFDAMQSAKAKGIDVLIADTAGRLQNKTHLMNELEKVVRVMKKGDETAPHETMIVLDAGTGQNAINQVQVFSEAVNLTGISVTKLDGTAKGGVVFNIAQNTDIPIRFIGVGEGIDDLQPFKPKDFVDALLEKEE

SEQ ID NO: 3586 - protein, 925 aa, M.catarrhalis
WMGNFIRVISMTKYYNDPDHIETQEWLDAFESVIKNADKDRAQFLLKALYNMAVQEGLPFNRLDTAYINTIPAEDEPTYPGDLHMERKIRALIRYNALAMVMRANQNNDDLGGHLATFASSATLYETGFNHFWRAPSENHGGDMIYYQGHGAPGMYARSFLEGRLSEEQLINFRREVDGKGLSSYPHPYLMPDYWQFPTVSMGLGPLMSIYQARNQKYLTNRGLIKDEDRKVWAFLGDGETDEPESLGAISMAGREKLDNLIWVINCNLQRLDGPVRGNGKIIQELESVFRGAGWRVIKVIWGDHWDPLLAKDTSGALKKRMEEVVDGEYQLYEARDAAFVRKEFFGKYPELEEMAKQFSDEEIIRLNRGGHDPKKVYAAYAEAMKTKGQPTVILVKTVKGYGLSTQIQSVNKAHQIKKIDESGLKYFRDRFDLPLTDEQLKELPFYRPSEDSAEYKYLMGRREALGGHLPSRRSGHIPLEIPELSVFNQVLQGSKGKEQSTTMVFVRLLSALLKDKGLNKHVVPIVPDEARTFGLEGMFRQLGIYSSVGQNYVAEDADALMGYREAKDGHMLEEGINEAGAMSAWIALSTSYSVNALPMIPMYIYYSMFGFQRIGDLAWAAGDCQAQGFLFGATAGRTTLNGEGLQHQDGHSHILFGTVPNCVTYDPCYGYELAVVMHDGLRRMYAQGERVYYYITLMNENYEHPAMPEGVEEGIKRGMYLLKDNGSTQVQLLGSGVILREVEKAAQILQDEFGITANVWSVTSFNELTRDGMACDDYNRLHPTADQKTPWVTSQLASHKGIVVAATDYMRNYSEQIRGWLPDSRPYVTLGTDGFGRSDSRAKLRSFFNVNAEHIVVATLKKLADEGDIDVRLVQDAINSFDIDADQAPAWQRQPQYDFFPDAPAPKATREPNPVPELVEDDNH

SEQ ID NO: 3587 - protein, 393 aa, M.catarrhalis
NRYNSSLKSCIINHILMRIRNAVMSQTTQSLPVNTDEIKGYRTQIDAIDEKIQTLINERAKVAQQVAVAKKNHENHPIFYRPEREAQVLKSVMARNEGPLSGEKMARLFREIMSVCLELEEPQKVAFLGPVGTFTHAAALKHFGKAATTVSLTTITDVFREVEAGSAMYGVVPVENSSEGVVNHTLDAFLSSSLKIIGEVELPIHHNFLVAEHTRVESLSRIYSHQQALAQCRHWLDVNFPNVERVAVSSNGEAARRLQNEWHSAAIAGDVAVAEYGLHKLYENIEDNPGNTTRFLIIGREDIAPSGQDKTSIMVSSPDKAGALIEILEPLRRHGVSMTSIETRPERPNKWAYVFFIDMNGHIEDKHVAAAIEDIRPLVKDLRVLGSYPKAVL

SEQ ID NO: 3588 - protein, 407 aa, M.catarrhalis
ILSKEFIMSQFFARLTPKQKQYLATIQTPYYLLDERAIIDNLSVTQKVCHESGAKALLALKCFATWGVFESMQPYLHGTTSSSLKEVRLGKECFGGETHAYSVAYADHEIKEVLGYCDKIIFNSINQLKRFGQLAHDKNIPVGLRLNPQTSNSSFIIADPARPFSRLGEHDVESIMAIADQITGVMIHNNCENTDFEAFSQSLTDIENRFGELFHRLEWISFGGGIHYIDQNYPLDKFINRLKNFSETYGVQIYLEPGEASVHQGAVLVTSVLDVMYNNKPLAVVDASIEAHMLDLLIYRQSSPLAYVNETTYDITGADFDGTSADETSVRIYGKSCLAGDIFGDYTLNEPLKIGDKVAFGNAAAYTMVKKNWFNGVDMPSIVIIRQDGEIMIQRQFDYEDYKASLS

SEQ ID NO: 3589 - protein, 248 aa, M.catarrhalis
FNKKPPSTAFYDWSQGYFMAITSPIIVAVDKHNLNDALSLADSLDPALCRLKVGKELFTVCGIQIIKAFHERGFEVFLDLKFHDIPNTTAQAVLSAADMGVWMTNIHAMVGTDTMRLCKSRLQDGGYDTLLIAVTVLTSMTQANLSELGIQRSVSEQVRHLAGLTHDSGLDGVVCSAQEAQLLKQKFGKQFRLITPGIRLVEDAKDDQARICTPAQALQNGSDYLVIGRSITNASNPNDKLHTILAGI

SEQ ID NO: 3590 - protein, 773 aa, M.catarrhalis
QRMKNPMDNTKKPLFEQLCVIGLGLIGASFVQAVHNANHRLNTPLVGQITAADTNQKSIDDALAAGVISSGSTDIFSAVCGSDLVMIATPVKSIYPIMKMLKHAIDLGDLASHAIITDVGSTKVSVAKAADEIFGAYHHFIGGHPIAGAERSGFDARNGELFVQHKVILCPSTHSHAADFAKIAKIWQAIGAKVIQMSASRHDEILAYTSHLPHLLAFSLTHQLASHDDNLDIFRYAAGGFRDFSRIAASHPVMWHDIFIANKPALLNALDEFVNHLQVFRQIIDQEDSEKMFDWLATARHARRHFGHMLAKKPMHKPNIVITPDAIKDTIMNQSYHIRPQNAISGVISVPGDKSISHRSIMFGALADGVTHVTGFLQGEDALATLQAFADMGVKIERNSDKVTIHGVGIDGLKAPKTPLYMGNSGTSMRLLAGILSAQAFDSVMTGDVSLSQRPMERVAVPLRNMGAKIQSTGKKGTAPLSITGSQTLNAIEYQLPVASAQIKSCLILASLWAKGTTTIIEPEVSRDHTERMLNAFGYPVQVDGCKISVTGGGRLTATDIIVPADISSAAFFMVLGAIGGGEGLTIEKVGMNPTRTGVIDILTLMGADITVMNEAVVGGEPIADITVRPSDLHGIDIPEHLVPLAIDEFPILFIAASCAYGVTKLTGAKELRVKESDRIQVMADGLATLGIDSKVLEDGIIIQGKGIQGEKNAIFGGGVIESHHDHRIAMSFAVASSRATDDIIIQGTETVNTSFPNFAELANRVGLSIEVK

SEQ ID NO: 3591 - protein, 207 aa, M.catarrhalis
KTLNIPLISISRDKRGILPRSADIALTLGLSEEACPLGLAPTSSTTATLALGDALAVALLHARGFTSHDFALSHPAGALGRRLLTRVSDIMHTDHLPVVHHQSSLNETLLVMTSGRLGLAVVVDDDGKVVGIFTDGDLRRKLAEHTNLTVEIQTLMTKTPKSVDQQMRASDALSLMNENAISQLLVLKDRQLIGVISIHDILKAGIS

SEQ ID NO: 3592 - protein, 106 aa, M.catarrhalis
FVIEVGRMQAVINKSNLIANLASVCEELEEDVVDEAVRLMIAMMVNELVYDGRIEVRGFGSFCLHHRSARIARNPRTGESVSVKAKATPYFKPGKALRESVNLVND

SEQ ID NO: 3593 - protein, 215 aa, M.catarrhalis
MEVEIIKIILAFIVLINPSAALAMFVNFTHGYSYEDKRRVARIASATVFIAIAFFSLFGEIMLRGLGISLGSFRVAGGILLFLIALGMMNDGNNPVKPNEDELELSQPKAKDPSSLTGIAVVPLAIPMMVGPGGISTVIIYSSQVSGIVGMSLIIVAGLCISILCYLSLMAAGRISKLLGDTGLNIINRIMGIILAAVAIEIVVAGLRTIFPNLL

SEQ ID NO: 3594 - protein, 739 aa, M.catarrhalis
ICHESVTNLSCLLAKITAFTKPAYYGKPKEIQMNNPHDFIEDSNPTSNPNFADILNQTVSRRTILKGGAGLTAAAMFGSLPLMASTNSTTAPTKTNLARPTKLQFKAVPHYTGNDMKVAEGYTARAFLHLGEPLIDGIEAFRDNREHSGESFLYRMGDNHDGMHFYGMVNGKFDPNQSNRALLAINHEYTNENLHPMGFFTQEDNNAAPIYRKKRLAMDVRRDANAHGVTVVELRKTGDRYEMVKNSPFNKRFSSATTVDFAGAAAGSKMLITKFDKSGKSTWGINNQCGSGMSPWGTYLTTEENFLNVFARGEDKAKIGTQADVALARYGLKENSTGGGYLWHTADDKEGIVTDEFSRWEATAKANDASADYRNGFNGFGYIVEIDPFDPKARAVKRTSLGRFAHENCAFVPPVAGKPVVFYMGDDARGEYIYKFVSKAKWSPSDVGKGLKAGDKYMNNGTLYVAVFNTDGTGEWRELSYGKVNHKDYPFKDQADVVINARLAADSVGATKMDRPEWISVSPITGEVYVTLTNNSKRTVEATDAANPRSYNNKGNQHGHIVRWRERGEHTATAFDWDVYLFAAPNDLTEQNLSNLSAENDLSSPDGLYFDPRGVLWIQTDDSAYTKTTNCMLLAALPSHVGDGKIMTTTTGRNTPVGAMATNDTLKRFFVGPKGCEVTGITMTPDFKTLFINIQHPGEDSPDVTWGAVPSGRVPRSATVMITKNDGGVILGESLQNMG

SEQ ID NO: 3595 - protein, 713 aa, M.catarrhalis
LFKEEEKSIMRLPETTRAERQTNQLARRIQEKAQLTGVNVSGTQISSQAFEMVTDFEPSGDQPKAIAELVKGVEADMRGQLLLGVTGSGKTYTMAKVIAECGRPAIIMAHNKTLAAQLYGEFKAFFPNNAVEYFVSYYDYYQPEAYVPASDTFIEKDSAINDHIDQMRLSATRALLERRDAIIVASVSAIYGLGDPESYLKMLLHIVVGDRVHRDAVIKRLVELQYERNELDFGRGTYRIRGETLDIYPAESESLAVRIQMFDDEIEKITWFDPLTGKNIKSVPRITIYPKSHYVTPKDKLEAASATIKEELAQRLEYFRANDKFIEAQRIKERTQYDLEMIGQLGYCNGIENYSRHLSGRPAGEAPPTLFDYIPSDALLFIDESHVTVPQIGAMYKGDKSRKETLVQYGFRLPSAMDNRPMKFEEWEKISPATIFVSATPAQYELEKSEQVVEQVVRPTGLVDPILEIRPVLTQVDDILGEINLKKSLDERVLITTLTKRMAEDLTSYLKEYGIKVAYLHSDIDTVERMKIIHELRTGIFDVLVGINLLREGLDMPEVSLVAIFDADKEGFLRSERSLIQTIGRAARHVNGKAILYADTITPSMQKAIDETERRRAKQIAFNQEHGITPKSASRAITDKIDTGDDETSEVVQIVLSQALAGVDENILHSPKLLAKEIARLEKQMQALSRELKFEEAAKVRDTVIALKELLVQ

SEQ ID NO: 3596 - protein, 347 aa, M.catarrhalis
WFKEVFMPYALLRPLLFSMNPEQAHEKTLQMLESANKAHLLGFVYAKQALPTECMGISLLNPVGLAAGLDKNGAYIDALSELGFGFLEIGTVTPKPQMGNDKPRLFRIKEANGIINRMGFNNHGVDVMIDNIEQAKYQGVLGINIGKNATTPVENALDDYIYCLERVYPYASYITINISSPNTKNLRNLQSGDALSQLLDGIKNCQLRLANDYGFYVPLALKIAPDLDLSQIDDISRTVIDFEIDGLIATNTTLSRTGVEGFRHGEEAGGLSGRPVNHQSTLILSQFADRIADKVDLIGVGGIETGELAVKKLHAGAKAVQLYSGLIYKGPGLVTDCVQALSGDRYG

SEQ ID NO: 3597 - protein, 177 aa, M.catarrhalis
KDKLMNEIYQKAKHIKLFAMDVDGILSDGQIIYNSEGIETKAFYVQDGLGLQALKQSGIILAIITGRSSAMVDRRAKELGISHIIQGQNDKLTALVGLAKKLGIELSHCAYIGDDLPDLKAVREVGFGISVPNGCEQTRAVSDYITTKTGGNGAVREVCELILKAQNNFDAFIATFQ

SEQ ID NO: 3598 - protein, 474 aa, M.catarrhalis
IEICYNATIDNHIIYCITTMSQPLNKLKTSPFSRRLSIAKTSLNIGKNWAKSSMNGLLMTKEEREIAKHTLMQEQADYLVGELGKLKGSVVKVGQMLALYGEHFLPKAVLNALHTLDAQTTPLSWHVIYATLKAELGEQIADFDIDRTPIGTASLAQVHKAVHKYSGQDVVLKVQYPGVADSIDSDLSIFKHLLKITNAVPQTKALDAWFEEIGELLHREVDYRLEAETTKRFAHYLADDERYVVPTIYDNYSTNRLICMSFEAGISLNDPIITTLPQDRKNALGQAAIEIFMRELFEWGEMQTDPNFGNYLVRYEDGIDKLILLDFGAIKQFDDHLLSIAYGLISAGYHQDKQQMMAAMTGYAFFDQLNGKPKSDIAEVFLMACEPFAHAQALKTRHGGHSSHLDEQGLYIWSGSDLYARVMNAAKNGMQSREFSLPPKEMMFISRKFIGAYALLVALNARTDSDALVKKFIN

SEQ ID NO: 3599 - protein, 66 aa, M.catarrhalis
LYPCVKLTNIAKAADGLISTIKARIILIISTSIHSSVQQIYIDYGYLFYHALAVFVLMKGIYLKNS

SEQ ID NO: 3600 - protein, 250 aa, M.catarrhalis
RILCEFFGLCRDFECDIMLYLPKIRLFMIHHDTPSHRFDRLFDAKFLHAPKTVQDQDRQNIFQSLTANTPLFLEIGAGKGKHAMQFAGLNADKHLIAIERTREKFNAFQKQAALGELNNLTFVHADAITFCVHFIAPNSLDGVFILYPNPEPHNKNQRWLNMPFFEFLLSRLKAGGFVRIASNIESYIDEACQLLDEVWRLPYTKYAIDSTSARTHFEIKYLARGELCQEIILTKPACYQTRFDDTPVKE

SEQ ID NO: 3601 - protein, 697 aa, M.catarrhalis
VVAWWWLNLRIFMPPKLGQKQILILSQACIIMSMLGLLSKFFLSSMRQLMTDTLKTADIVWKEDHNGCLIPTSRDFDDIYFSQAGGLSETYHVFIHGNRLTERFGQLTKNERFVIAETGFGTGLNFLAVCQLWQKIAPKSARLHFISTEKYPLGHDDFAQALSAWRTDDSFGDWVDALIQVYPLPLAGCHRLHLSEKITLDLWFGEALDTLNEIANNQHEHSIRIDAWFLDGFTPAKNPDMWSDALFKAMAQLSHRKTTVATFTAAGFVRRGLIDAGFDMVKSAGFGRKRQMLCTAPMPNQPTLNHYQIGFKPKKIAIIGGGISGVSTAAALSHRGHVVHLFEPDDIMAGASGNPCALFSPKLTLLDHATNHLPTVSFLYSYRHYKAMNLYSQIFDQIGVLDFLLPSQKTAKKRQALIDEYPKSLISTHYPQKDSSALGQDLRQTDIVAHIPMGGILYPINIAKLLKKHFIHHPFKVVRFQEQENRVVLTAFDGQSHQNFSFDQVVIAAGFASHLIDNRLFNCRKIRGQVTWLALTNGDDPKKPTQATNAIKYDGYSTEFFDSKSQSKSLLFGASFIRNNTETKLSDDEHLSNFQKFSQALPNYCQSLNISKDTHFEGRVGIRAQTPDYHPLVGKLSDSDHIFCLYGMGSKGFSFAPFCAEILADLMDGGILPMSSKLLAKLSPNRDRLNTPIQEED

SEQ ID NO: 3602 - protein, 154 aa, M.catarrhalis
IYRCQITMSLSPTAMLIRSHRLLMYLHATPSFYLMRWPVAEVTQASAIIIGVSSVDYSGYPDCRPDYIAAFETMANLATVSGRQGNHLSIIAPLQNLSKADTLTLGISLGVDYSMTVSCYQADALGRACGHCDSCHLRRQGFMDAKIADPTRYQ

SEQ ID NO: 3603 - protein, 305 aa, M.catarrhalis
SIYRLIMVIAMAKTVTTTPKGLLTVLSAFLIWGCFPLYFKELIEYDAIEIIVHRVVWTFVILLGITIITRRFRWIDQIKKQPKWLFLTFLASVLIATNWLVYVWAVTHDQVLEASLGYFIHPLVGVLFSMLIFKEKLRLMQKLAVLLAAAAVGIQIVWMGGLPWVSMLLPLSWGLYGVIQRQTPFDALDGLFLETALLVPISLIWLQFSHVASSSMAFWVSSEIWLLMLAGPVTLVPLLLYNISTKLVQFNTLSFLNYLTPSLIFLLAIFYYHEPFDAKRLLVFVLIWVGLLMFSADMFKHKKGA

SEQ ID NO: 3604 - protein, 1208 aa, M.catarrhalis
QFNRFLYFHFVSYFMFNFTHTQSTLRDAITSAYRLDEVTAVSNLLETLNFNNDEKSHISDLARRLITQVRTNRSKSSGVDALMHEFSLSSEEGVALMCLAEALLRIPDTTTRDRLIQDKLSDGNWKSHIGHSPSMFVNAAAWGLVLTGKLTQPTSEKGLSSALTRVLQKGGAPFIRAGVNHAMKILGKQFVTGQTIQEALSNGKEREKLGYRFSFDMLGEAAMTAEDADRYYQDYVTAIHAIGKDSVGRGVYDGNGISVKLSAIHPRYFRAQHARVMNELLPRLKALFVLAKEYNIGLNIDAEEANRLELSLDLMEKLISDPDLAGFNGIGFVVQAYQKRCPYVIDYLIDLARRNHQKLMIRLVKGAYWDSEIKWAQVDGLDGYPVYTRKVHTDVSYLACAKKLLAAQDVIYPQFATHNAQSLATIYEMGKDKEFEFQCLHGMGETLYDQVVGDNNLGRRVRIYAPVGTHKTLLAYLVRRLLENGANSSFVNRIVDEQVSIDELVESPIDIVKANGISQNPLTPPPRHIYGDRKNSLGLDLTNEHTLGRLEDLMQPASQIDFNVSSLTAVDVSHQPAHTVLNPSDHRDVVGQVSFIDPNSVPDVITTALNAQTNWQTVSAAERAAILRRFADLMEDSAHMALLMMVAVREAGKTLLNAIAEVREAVDFCRYYADEAESLNLSSPVGTVVAISPWNFPLAIFVGEVVSALVTGNTVVAKPAEQTSLIAHLAVSWLHESGVPKDALQLVLGAGDVGAALTSDERINGVIFTGSTEVAKHINKLLAARDDNPVLIAETGGMNAMIVDSTALPEQVCADVLASAFDSAGQRCSALRILCVQEDIADHVVAMIKGAMDELIVDNPAALSTDVGPVIDEEAQKNLLEHINALKQIAPYHEVAIASDAPSTFVAPILFELKDLSQLKKEVFGPVLHVVRFAAHELNDLIDSINKKGYALTHGIHSRIDGTIDQITDRIQAGNVYINRNIVGAVVGVQPFGGHGMSGTGPKAGGPFYLQRLSQLTNWQKPTVDTPASIDHTALSKVQRLAHKLLTSDNEKANFDAVAQQAINSSLNQASVILPGPTGETNTLSWHAPKQVALYGGSQSQALDALAILAANGIITQVRPSHVLAEHANELIGVLKVVEEPAVNANDIIIALSTMPADEQVSIAKLDGSIRRIIDATNGLDIARLYHEVSQSYNTTAAGGNASLMASA

SEQ ID NO: 3605 - protein, 72 aa, M.catarrhalis
SKLRLLYPPFGWRAIFDANIQRKAAVDAKTRCTTGRRRCWHSDCMDGRVALGEYVIATVMGTLWCYSKTNAF

SEQ ID NO: 3606 - protein, 288 aa, M.catarrhalis
SNLRSNHMDNTQTTHLSSQLHNAQMIKNGNDTTFYHTDNAQTDTMSLENQFDAKDSSSWFNETLLLSWQQTFGNIKHGYVKAADNLVDELLVTLTQKQVNDALYNFVTKNVGLLHNLKLDIHDNWLRLTCTVDIMGLYTTVASNFELVHLQLDRHTQRLVLKQIGDTDVIELHSKQWYKAPAARLGVGLYRTLLRKDPLPFILNKIKIKGIPFTGHKGNIIYLDIGRWLKNNDMIMKNLKKVQINDGYLKAQQLLLKVQPNFGDILSFGDPDADIITEKDNPKHQKAD

SEQ ID NO: 3607 - protein, 181 aa, M.catarrhalis
VFSRFYMKADFVITKYLFLSCIVSIPMIASALPSDTNQPIRLLADRATYSERTGVTTYSGKVTIEQGTLKIAADNLTVNLDTNNRSIKSAVATGQPATIQQVVTQEKGLAKGQANRIDYNAVSGIVTLTGNAKLTQAGSSFSGNTIRYSLSVGDVEANAGGGQRVELVFPPSDSNSRSGLR

SEQ ID NO: 3608 - protein, 166 aa, M.catarrhalis
AAKRRCICQSKSGFAGSSMISQTLSLHSEADTQALAKKLAQMNLSGSVWLSGDLGAGKTTLVRYWLQAMGHQGAVKSPTYTLVEPYQINLQGRLKPVYHADLYRLNDPEELDFIGFYEYFDEPNSLVIIEWASRASQVLPKPDYHIDIIRHLDDKRVVTLMGLEEV

SEQ ID NO: 3609 - protein, 360 aa, M.catarrhalis
  UNSURE (250): Identity of amino acid sequences at the above locations are unknown.
AIMSINRPITPPNSWQKFGDIHWYPSDLSEHLFQAIIDIGEGIKLCVEAGGNPEHPPMIFITGLGSQMMFWSDQFLKRFIDAGFFVIRFDNRDTGLSSKIQIDGLPRLNTFKMMLKMQAGLSNRSEPVAYTLTDMAEDAARLIKTMQLHNVNLIGASMGGMIAQIVAARYPKYIKNLVLLFSTSNRAFLRPPNPKQFMTFVRRPESHSERDMVRHSVWFMTAVGSPGHLDIKGTRAIAEKRYQRNFHPLXVSQQLTAILASRSILRFTKQIRANTLVIHGNKDGLVAPNHGKILAKVISNARFVLVDGMGHDLPNYYYPYLNGLISEHWPSLTLDGVEGHIHFVKTGDIRFEDFYEAHHI

SEQ ID NO: 3610 - protein, 204 aa, M.catarrhalis
CTFGKRRMMAKAVSTNYHPPSFLPDLPTMHLTASHGKLILLDWQDIKTQKLLNQANQHAVFIKPSQLDINQPDQAILLQTTEQLNEYFDGTRRNFSIPLDFSYGTQFQQQVWAALLTIDYGQTISYAKLATLIDKPKAFRACANANGKNPLSLIVPCHRVVASDGGLGGYTGGVAIKKALLDFEMACHLSKNKTPTDFDYLCYN

SEQ ID NO: 3611 - protein, 686 aa, M.catarrhalis
YMAGDIISRYVTDRIQDNHQWYAKKQVLAAECTLRLLDFELYHIVQDALLFQLNQGHTILHINDHDDLNNRHGLNGMIPIWQQKIMDSCLTVITHALANEGMDWAAFFDAYHRCADDTIKIKQFVNHALNHFRQQVSLLDHTVMEIEQLSALFLSMLRIYYVLYKNANTLKQFVSLLHNNTFFGDILASNIQSIPTNTPPIYFSDQAGGLYLWTSRAYLAESQLMTHILRISQADVPIFALDQLPNSLNTEQRDAIKLVSKQAFCLITGGPGTGKTFTVAQIVIALNQRDEHKKMRLGLAAPTGKAAQRMSESLLKSLDKANDIQLPKPKTIHRLLGIGANGSPRYDAKNQLPLDMLIIDEASMLGTELASQLFAAIATGCRVILLGDTHQLAAVDAGAVLADLCRIERLRHLRVNLTASKRFTDTSGVGQLAKLINDDRQNIHFDEIQQLINCHTKIDFHPITHALMYNDTYQKLSQDYQDYFLASKRLRFSFAKLSSQDAIDSVKKLFKILDTYRILCASHLGTFGDDQINDYLSLAHRAVQKIPPSVSPWFHGRVVMITKNLYDLGLFNGDIGICLWGSSGLSVYFEGEALRMVAVDMLSDTVVSTAYAITVHKSQGSEWQKVAIIFDGNSERLLSKELIYTAVTRAKSAVHIYSTHDALINAINTPTVRQTGLDKVSDGQQS

SEQ ID NO: 3612 - protein, 103 aa, M.catarrhalis
FVQGENMPLFVIIGHDVADSLDQRTKARPAHLERLNTLMAHNRLILAGPTPIAHGESAMSGSVVVAEFEDIHAAKAWAEADPYIIAGVYHHVDVRPFIQVLPK

SEQ ID NO: 3613 - protein, 139 aa, M.catarrhalis
LNKGLIMHIILIILLVLAFAYSLALVVLNNQAIAVNLLFSSVANMSLGLVLVATIFLGILIGILLALLLFRVFQNKWEISRLKKEKASIQAKLSEANLQLAQQAEEIRRLELEYQTNKPTLADATLQQVTNDGYHHPNL

SEQ ID NO: 3614 - protein, 414 aa, M.catarrhalis
GMFMTQLDPNWQTDALDLSLGYFEQTLAVRGGYHRTDEGEHNEAIFTTSSYVYASAADAADHFNGNKKGNVYSRHTNPTVRAFERRLALLENGERAVATASGMGAILTMCLAYLKAGDHLLCAKQLFGSSIALFDGYFQGFGVEVSYVDCFDNEAWAAAIRPNTRVLYCESPSNPLAQIADLRYLSKLAHAHDALLIVDNCFATPAIQKPLELGADVVIHSATKYIDGQGRILGGALVGRDELMEKAFGVVRTGGISLSPFNAWVLLKGLETLSLRMKVHCDNANQVAQFLASHPNVKKVHFSGLSDHPSHELAKSQHTALEVTGGAFGAIIGFEVADQASAWQVIDSTRMISITNNLGDAKTTITHPATTTHFRMTPEQRIEAGVHDGLIRLSVGIEDARDIIKDLAHGLDNI

SEQ ID NO: 3615 - protein, 381 aa, M.catarrhalis
GILMTTTPKPKTATTSSTTATTVPKKTTSTRTKVSTATETKPKPSKAEAIMTQTVGQLEELLEHATPEELAEFGEALKEYLPTTHVISQVRTDKSRDTQLSDNWREGGYPYKYRLSRKNYEAQKYKLQIELLKLQHHIKTTGQKLVIIFEGRDAAGKGGTIKRFMEHLNPRGARVVALEKPTEQERGQWYFQRYVQHLPTAGEIVLFDRSWYNRAVVERVMGFCTDEEYRIFMHQVPEFEKHLVESGIHLVKFWFSVSREEQRVRFASRENDPLKQWKLSPVDKASLNKWDDYTLAKEAMFFNTDTAEVPWIVIKSDCKKRARLNAMRYVLNKLTYENKDIAQIGNIDPLIVGRAGALYEMDERTDLTVSTQLPRKTTTTK

SEQ ID NO: 3616 - protein, 202 aa, M.catarrhalis
KRLIMRIRKLFKFENAHIVRNCSSDRCKRSIHGHSYEVELILEAHRLDHGQMVYDFGLLKHHIKDIIDSFDHAITFWDQDDTRYIQACKDFSARWISLPVSPSAEQFSRVIFFWADAILNQTVMQNGEQDISVYSVIVHETATGYAQCFKQDVENEQMGVLSLADFEFSEQVKSEWSDPQMYDKLLKDDAFVNPKVDLQVQV

SEQ ID NO: 3617 - protein, 473 aa, M.catarrhalis
GYTMKLMPLAFVIGAAVGLSACQSLDHTQNAISTTKTPSTQAEHHDIYTQTLKNGLKVIIKQDSRAPIVMTQVWYDVGSSDEPIGKGGISHFLEHMMFKDAKGVSHDDYQRLISHFGGELNAFTSDEFTAYYESLPANQFPLALQIEANRMNNLILTAEEVATEKQVIKEERRLTTDDKPTAKAHEEFLAIALPNSPKGLPIIGSMPEIEAITVTDLQNWYDQWYAPNNATLVLVGDIDPKTALPWIEKYFGTLKPSSLPKRTPLSQPSHRGYTQANSYQNVKVPSLIMGFNVPTLGSRTIKNHTKEAHALSLLSDIADGGLSARFERHLIRKLQILNSVSIRYNMLSKSDDLFTIIATPREGVSLADAEAAILAELNAITNDQITDDELARSRAGLLSSLVFANDSIAKQASNLGALSALGLPLDTLDTLPKALDKVSKSDIQAVGKKYLTKDNLTTVYVLPKNTQSPSDTH

SEQ ID NO: 3618 - protein, 245 aa, M.catarrhalis
GLNMTTVLSMRHLGKRYGQRWVVEDVSFEIEQGQVVGILGPNGAGKTTSFYMVIGLVPMDKGQVILGDQDISKNAMHERAAKGIGYLPQEASIFRKLTVEQNIMAILQTRKDLTQTEQRQQLEKLMADFHLEHVRHSLGMSVSGGERRRCEIARCLASNPKFILLDEPFAGVDPISVSDIMQVIETLRERGIGVLITDHNVRETLSICQKAYIVSEGKVIAQGNKDEILFNELVRKVYLGQDFVA

SEQ ID NO: 3619 - protein, 119 aa, M.catarrhalis
MSDIVFIQGLNIDTVIGVYAWERVIKQRLIIDAQMVCDMTRAIADDDVAYVIDYKAVCEDIEKLCHEVQAELLETLADKIAHHVLTNYPCCEITLTIHKPNAIKQADSVGIKIIRKAGV

SEQ ID NO: 3620 - protein, 425 aa, M.catarrhalis
ECNMTTKTKKAHQHLEVIRRLEAQNYIFTQDPKIITEAVKLENGTAFDKLFIRAQKIDSDARIMQILSDTQHGILSVIRLIYLLYFIFALIGVASLLGTQAINFFYLMVALLGWHTLSLVWWLISLAFSHRPSMLSSVVEHIALKNKLIEKLSACDKNIQKVCFSVLNDTIKPIKRWQIASILHGAWLFGLMGSILGMLGLFLFKSYSFHWESTLLTDHHFDRLITIIGYIPSQLGIVLPSASSQTPAQFAILAMTSVIIYAILPRLAAYLYSRIKARQQFRIDTKAPYYANLMNFYRQTIINADDYQSPKPTTIAPIVLSDRLVIAALEKPYYHHPIPINAIKDFGVIDTHAQIKMLLADALHLSAQIYLIINTDTVPDRGIVRKVERLASHQFGIIAMLVGEQIHDDAWKVALNERRIPIFNH

SEQ ID NO: 3621 - protein, 372 aa, M.catarrhalis
GSLMDLPHYTDLPNNSVVCLMSPTASGKTDLAFKLYDTGRFELISVDSALIYEGMDIGTAKPTKDELNAYPHHLVDILPPTQSYSVANFVQDVERLIGEIHARNKIPILVGGTMMYYMALLDGISAVPQTNPIIRNQVKIWHDEMGNKALYDYLKQHDPVICQKLKVTDTQRITRAVEVHLQTGKPLSHWQSTPKLAISHHPKWHWYAIIVMPDRAWLHERIEQRLQVMWADGFLQEVIGLIKQHPNLTADMPALRAVGYRQVLDYLIAIDHACVTAHLGLKPYYHAQKSKQNQEINSIHQDFNKKSKKTMTNTRDLACQDMKNKALYATRQLAKRQYTWLKQLAQTDKPTKNNLTIVSFNSIKQVEQQFLQ

SEQ ID NO: 3622 - protein, 441 aa, M.catarrhalis
LLSIIRANTMSQLNIAYTDGACKGNGKQGVSAGGWGVYLHYFNGDERHLWGGEPDTTNNRMELMAAITALEATPAQIPLQLWTDSGYVKDGITQWIGGWKLRGWKKADGKPVLNQDLWQRLDQLTQNRIIDWQWIKGHAGHAGNEMADQLANKGVDGFGDETLPNPIVHNDENFMINTPKPKHPYAYNTIQNPDYDGDTSRTNTDFWPILPKPDNRDAPERQLIMDTETTGFNEAGGDRIVEVGIVELVGRKFTGNILHVYINPEKHMDDAVIQVHGISNAFVADKPKFAEVAQQIYEFMAGSEVIAHNAAFDMKFLNMEFNRAGLSNFANSVKVTDTLALAKQMYPGQKNSLDALVKRLGVGQKDRTFHGALLDSEILAEVYLAMTGGQIAMAIDDDNTGGSNTRSTGSAFYDLSQYADSLALSESDIEADALWRAKVLS

SEQ ID NO: 3623 - protein, 1318 aa, M.catarrhalis
DTAMTDTILTIPPTPPKPSEQIAALQCTLEQAYLIEASAGTGKTWTLTGIILRLLIEKKYPPERIIATTFTRAAAAEMQERISERLHSFYGLMRWLQGMLSTQPEWFNQTAPIEQIITYADQAGYDAADPINEHLLRFILSQQATFLNEVVYRTGLLLTSLDKLFVGTLDSLAQKWLNEFAAQIGHQSGMEILNNAEQKVAAIVHDEMRAEEVRLKHAQPEFYQIFKAFYPNFFSQVDAVVKIVNKAINFYSAPIDELMPINTDISLVKAMIDQIITTDFTGFTPYFDANFRKQVAMNQSLGFGKLIQYLPNLLSLIQKHGVLFVRFVDNDALKLIDAIIKAMDKDWQIFNKSANPSDINQFLALPLQALSDIANVYLTLSEQTNLYHTHICRHIILSAKSQIAQRLETHGQTTFTLQMVRLNEALRNSPALARQIRHHYPVALIDESQDINGLQVELIELVYLNEIANYHKNLIRYEQIGGEKPKLPRGFLLLVGDPKQAIYRFRGGDVTNYNLIKHYGNQDLLIKAPLMNQSLSLTVNRRSSKALIEALNAWFDNNHQDAVANHANLGQGIFYQQIQAHKDGGGIHWQSDAYADYYGKYPIAVLHFDHIEAGQKAAQRAEQIARHINTILQGDHTLHGQKILPKDIAVLGRTADTLDRIKSELDQLNIPAIIPKEMNIFITQAADDLLALIGAILQPNHSENLGKFLVSSLVGMTLKQAINIIEPNDQQALDNDLSETQNLKTHLLAYLKKSYEKWQKFGVSSALAYALHHSPIDYDDDKSPWLKAATQGERYLVDLERLVALVSEQSQLHEMRIIAWYHKQMNADVDSHNKRPILPSESGVNLMTIHKSKGLEFPIVYVIGMDEKPKNENGLTIYPYTNHNFQRRLSLSQGNLIDENYYYHINQQELIDEIRRLGYVALTRASEQLYIVGGDLSKKTSKEMPLYQWLDCAGEKTLSLPDRLKGWVDWIDLTEADLFSQPYQTKLPNLSTKNYAPWDMVMTKTQFFGEYKTSFSALITRLDKSAISPDEADIDQLSVLTDMAASDQFDDIRTSFFKGSLAGDFLHKVMQFLPTDRLALASLHDAHRIISGVIYEQGRKLGIAERYLPTRPAQQIGTRINSNEHQADDHTKLVAWIYQLAYAPFRASHRSLMSLPMTVQLRELSFTLGLGDTFSITRLNEVFKAHSDKDLVLLDDDYHTMRYRYLRGEIDLVYECDRRFFIVDYKSNYLGSTPDEYHDHAMAAVMDKVGYWLQAAIYQVALHRLLKIRLKDYVGNEAAYLGAVEYVFLRGVQEGNEKTGHLCWQPPLSLILALDEIL

SEQ ID NO: 3624 - protein, 172 aa, M.catarrhalis
ATQMNFRMLSVLGVIALAVAVWFFYQEDIEVKPALPEVPTVDSEVTQIKAIQTDPKTGATEYTLTADSLIQNANGQDEMLGATIHWQPPQGETYTLTADRATLEQNSGDLRLSQGFRLVRAATAAKPEMIIEGLNIIGNTKNRTISSRDPLTVQQGIDRFKAQGFRAVLQTG

SEQ ID NO: 3625 - protein, 229 aa, M.catarrhalis
FNKIDQINLSQQFITTMPLLFNDQVKANFMFNQLMTIQTIHRHPLPPFTPPNACVMMLGSFPPPPERWAMPFYYPNYNNDMWRILGLVFFDDAKRFIDSTHKTFDQDAIEQFLTKTGIAIGDTAEQVIRQKDNASDQFLQIVTPADIEKTLKQLPWCHAFITTGKKATEVLCQQFTSQKIPNIGEQVQLLIANRRIDLYRLPSSSRAYPLAIDKKADFYRKVFETLGVL

SEQ ID NO: 3626 - protein, 350 aa, M.catarrhalis
YFKIQVYDTMMTDNKLQKSLKNQHILSQPLSIGGLKIENRIWVAPMAGVTDNPFRRLCKSFGAGHAVSEMIIADTALYARKKSLYRANFDGEIAPISAQIAGAEPDKLAQAAQFQVANGAQIVDINMGCPAKKVCRKLAGSALLQDEDLVRRLLDSAVLAVDVPVTLKTRLGFANGQENILKIAQIAEQAGVAAITIHGRTREDFYTGQARYELITQVKKAAKIPIIVNGDIDSPQKALDIQAKTGADAVMIGRAAQGKPWLFQQIAHFANTGELLASPTVGEIHEVVLRHLDELYRFYGEYSGCRIARKHIAWYTGGLPNSNAFRDAMYACETTKEQFEVVDKFFKTIS

SEQ ID NO: 3627 - protein, 479 aa, M.catarrhalis
LVKMRLFLEVFMKNQSATHWALSVMTISVLLSACTSHVTHERAPIKVVQVTPNPAQVAPPAQVPTQALTKVPTSTVQPTTAKPASVVVQKSVVVQKPAPTNTPSMTTQSHYATFAEWKHDFIHRALAKGINANSLNALMGNATLNQRVIELDRSQAEFTKMPWEYVESAASSNRISQGRSKLNENLSILTSAESIYGTPKEITAAIWGMESSYGAGMGSMDLVSALSSLAYDGRRREFAENQLLAMLLMIERGDVAASQLKGSWAGGMGHTQFIPTTWIQESIDGDANGRKNPWNRQDALTSTASYLANAGWIRGLQPFYEVRLPTGFDFLQLNSKRSLDAWKALGLVSASGEYFGGVHEAQLWLPAGQYGPALLLTKNFEVIRVYNNSSSYALGVSLLAKKIAGGHDLVQSWPRHEQPLSRTQIINLQKNLTAQGYDTQGIDGVAGSNTRQAFARWQAANGQIPDGFISQRTAGHLVW

SEQ ID NO: 3628 - protein, 253 aa, M.catarrhalis
LMKIMGEVIPTWVLMGAVVLAFCAGILNTTALMGITHISASHVTGNVSLFVVSMLSNDWLNFKLLLISIGSFWVGSVLSGAIIGSSELNIHQNYGYAMLLEVLMLCLSLWMYLLTHHFLGQMMIAMACGLQNSMVATYHGTVIRTTHLTGITSDLGATVGNWLVGRHVSLHKIILHSSLWWGFFIGSISAVLLYNYIGYLSMILPIMIILIAALFYHQMGKLYTQILRLVRLKLIQNQRKKRRSKPHHSKLST

SEQ ID NO: 3629 - protein, 419 aa, M.catarrhalis
GGLMSQAKNVLIIGAGGVAQVVAHKCAMANDIFGEIHIASRKIDKCQAIAKNVAKKGSFKRDAVLHTHAVDAMDHHAVAELIRKTNTDIVINVGSPFINMSVMDACIETGTHYLDTAIYEDPHKICETPPWYENYEWKKREAFKKAGATAILGVGFDPGVVNAYARLGVEYFDKDSVTDIDIIDINAGSHGKYFATNFDPEINFREFTGVVYSWQNSQWQTNQMFEVKRTDDLPIVGIQNSYLSGHDELHSLHKNLNVPNIRFWMGFGDHYINVFGVLKNLGLLSEQPITTAEGLEVVPLKVVKAVLPNPASLAEHYTGKTCIGNKVKGEKDGETQEIFIYNIIDHEDAYAEVGSQGISYTAGVPPVAAALLIASGEWNVGTMVNVEELDARPFINLLNTMGLTTRIADKDGDRLLAFG

SEQ ID NO: 3630 - protein, 543 aa, M.catarrhalis
KRLIDPKLPILLGFATIVSHQNYAKIMPKNTTIKHVEALGSTLDDPEMLLNKHRQIAESFEAKLAKEAVFDENFNNLADAHLSLSDYLTAVKMVIDDSFDHEVWVRAEIRAMNTKGGHYYFELAETDDVDQITASCRATLWRFRAKTVMSKFTKMTGQSLQAGILVLVKCSASFHANYGFSLNISDIDPNYTLGEIAAAYTQMKKRLSEEGLLHLNKKHAIPFDIRHVIVIAPEKAAGLGDFRAEADRLALAGACQFHYHYATFQGNHAPNEIRLAISEGMNNFKNTYDTLPDLLVIIRGGGAVGDLAYLNDFELAALVAECPIPVWVGIGHERDSVILDEVAHSSFDTPSKAILGIESHLVKMTRQAVATMERLTKMTNTHLTMAQANSQRQIEKIQRSSLHAVNMAKKDNLYQLSHIKSTAKFRHHQEKSALTALLAQTQKSSLAIISQAKHTTKIHLDQHNILFDYLSKLKKDCRHLQSLILIQHPSRMLKKGYTLIHNAQTNESIHSTKTLQQNQSVKITFKDGTVSAVIKDISTHKNT

SEQ ID NO: 3631 - protein, 559 aa, M.catarrhalis
ENMMEIKAPDLGVESAEVAEIMVKVGDSVSENDNMILVESDKASVEVPSTGAGVIKEIHISVGDRISEGDLLFTLDSDQSGDAQKTDSKSDDEPQTKQSAKDEDDISIGDDKQTDDQPDLNESAGSQTHHLPDLGVDSAEVADIMVAVGDEITKDQPLILVESDKASVEVPAPVDGVIEEILIKAGDSVSNGQAFITIKSKGISAKKSSNKEQPAEKTKEEDTKANQAAVSESKNKSVQSPQTKLPEAVVNEKARHVYAGPAVRKLARELGVDISAVTGTAAHGRILKEDLFGYVKSVISGSTSQAKSGTTEVRSGLPSLPDMSNKEIWGELEIQDLTRLQKVSIPQLNYNTYLPQVTQFDLADITDTESLRNELKGEFKAEGIGLTILAFIVKAVAYALTQTPKFNSHLSDDNTQIIIRKSVNMGIAVATDDGLIVPVIKNAQDKGIKQIAIEIGELAKKARDKKLTAKDLQGASFTISSQGNLGGTAFTPLVNWPQVGILGVSEASYQPRWNGKEFEPRLMLPLSLSYDHRVINGADAAVFTRHIAKLLADPRRILL

SEQ ID NO: 3632 - protein, 277 aa, M.catarrhalis
DIMITYTTERLDNLPILFQPLNLQSLSNADRQSIAAIDAALPQTQCGLCGHHDGCLPYAYGIVMHGEAINLCVPGGQSVTDTIANILNKPTKPATPSQWQIDPLTNRPKEVRAIIQEADCIGCTKCIPACPVDAIVGTAKHMHSIITDLCTGCELCLAPCPVDCIDVIPHLRQLSDADRITEQNHLRRRYHQHLDRVAMTIEQGTKPVVSTIESAMVNVLNQRQNTEIDEIHAKNAIAAAKLRTQIKKLNKQLTLKADADLQNKLDKLNAKLSELQP

SEQ ID NO: 3633 - protein, 104 aa, M.catarrhalis
FWWILSSLEPMIAPLNTDPTQKDPMDINNNLKFNQSLLSIETTNKLTLPVTCDAEIWVIPIKAVVFKIPAQNAKTTAPINTQVGMTSPMIFINHHLLSKSALTV

SEQ ID NO: 3634 - protein, 377 aa, M.catarrhalis
RICVKYALSVYLVWFGFIMITLLKKTTLLATAFGIFFGLTACSNNTKTSIQNTDTTASSTEANQDPIELLNVSYDVSRDFYKAYNEVFINHYLTNYPNTKIKIKQSHGGSSKQALSVKNGLQADIVTMNQGSDIELLADAKLVDGNWRHAFPNHAIPFTSTIVFLVREGNPKGIKDWNDLATSGIDIIIANPKTSGNGRYAFLGAYGYGLNAYHNDEAQTHAFVKALLSHVKVFENGGRAATTTFAQRGIGDVLITFENEANVIKSKFGNVDIIYPSYTVNAENPIAVVKSVTDNKGTTKAATEYLNHLYSDEAQELATKFFLRPSSPDILAKHADKFPVMTTFFPNDVFGDWASIMKTYFSDGGLYDKLAVQAQNQ

SEQ ID NO: 3635 - protein, 137 aa, M.catarrhalis
NMLLLWPVFLMNEMAMKQNNLAPSDYIQDAIDAIRTEQRALELLIDELDERFVNACQTILNCSGHVVVTGMGKSGHILAGRLALLNVFRLRTTVMHPGEAGHGDLGIVAYKAMYSLPSQIRANKIKRACDFGGGKKR

SEQ ID NO: 3636 - protein, 78 aa, M.catarrhalis
KRFFGDKKVYTGQRFNIGAGVWDLERGVIFIRGLKKVSKGKGCSLLKKFRKLVFRRSLRKFGSLFYGGALEILRGFCF

SEQ ID NO: 3637 - protein, 70 aa, M.catarrhalis
TDSYSVVNLFTLTTIARWNHLIPSRTQEVKRLSADGSVVRPCESRSSSAPYFKPLFAEAKGGFVWGLNQS

SEQ ID NO: 3638 - protein, 335 aa, M.catarrhalis
YKQGFLFMKQPVRVAVTGAAGQIGYSLLFRIASGEMLGKDQPIILQLLEIPVEKAQQALQGVIMELDDCAFPLLVDVIGTDDPKVAFKDADYALLVGARPRGPGMERADLLQENAKIFTVQGKALNEVASRDVKVLVVGNPANTNAYIAMKSAPDLPAKNFTAMLRLDHNRALTQVAKKTGKAVKDIKKLIVWGNHSPTMYADYRFATINGESVKEMINDQDWNANTFLPTVGKRGAAIIEARGLSSAASAANAAIDHMRDWALGSNGEWVTMGIPSDGSYGIPKGIMFGFPVTTENGEYQIVQDLQIDDFSQERINITLNELEEERAAIDHLFS

SEQ ID NO: 3639 - protein, 85 aa, M.catarrhalis
KEIVMLGDIEYTMNELFAQLGLESSDEAVEKFIAENQLDEETNLKNAPFWNDSQRAFIQEEWKNDAVWAMVLDELNTRLHEEHQS

SEQ ID NO: 3640 - protein, 399 aa, M.catarrhalis
VSGTRSLDAIGEAINKNGKVIVTGCLGKDAEKIRTMHPAVLAVTGAHAYEEVISAVNHHVPKPIKSKEYDPKIDLINDAGIKLTPKHYAYVKISEGCNHRCTFCIIPSLRGDLVSRPIDSVMKEAVALKKSGVKELLVISQDTSAYGVDLKYKTVFWEGWPLKSKFYDMCEAMSKLGIWVRLHYVYPYPHVDAVVQIMADSMTASAGMGGLLPYLDIPFQHASPNVLKAMKRPAMSENTLERIQAWRAICPDIVIRSTFVVGFPGETDEAFEYLLDWLTKARLDRVGCFTYSEIEGAVANDLPNPVPESVKQSRYERLMALQQKISAEKLAEKVGKTLVVLVDEIDTEENIAICRSYADAPEIDGHVYVDNIDATVKAGDMLTVVIDEASDYDLFASFG

SEQ ID NO: 3641 - protein, 140 aa, M.catarrhalis
FLPAILIRQYHSSQTTMSSPIVFHPKTVHPKTNHQNTPLPSEPAYHHKANHNQNRSIDQSGAVATSTSNGTPKIGFVSLGCPKALVDSERIITELTYEGYQVANDYDGADLVVVNTCGFIESAVQDLWTPLVKRLIKMAK

SEQ ID NO: 3642 - protein, 242 aa, M.catarrhalis
LYSYFKKQTTKVFLAENVSGMLANRHSDAVKSILNMFDDCGYDVTVNMVNAKNYGVAQERKRVFYIGFRKDLAINFNFPIGSTAEDDNKITLKDVIWDLQQTAVAALDKNQTNPKAINNNEYFIGSFSPIYMSRNHVKAWHKQGFTVQASDRQCQLHPQAPKMQKYSTNDFRFIVGKEHLYRRMTVREVARIQGFPDDFKFIYQNVNDGYKMIGNAVPVNLAYEIAIAIHDCLQNHQATNHL

SEQ ID NO: 3643 - protein, 153 aa, M.catarrhalis
LPTKPSSHQPPIKLNKVINFMNQTKLTKVRADKWLWAARFFRTRSLAKEAIEAGKVHMNGAKIKVSKELQVGDTLTIRQGHATRLEEKTIIIKALSENRGNATLAATLYEETDASKTQRAFMAEQRKLLNLARPDSRPDKKQRRELNKFKHHW

SEQ ID NO: 3644 - protein, 74 aa, M.catarrhalis
CVHCPPMPWGSQVIQSQFLECHLMWMSPPHRFGRYCGFGYGLPCDGRQVRWAVVYFGGWFLGELFLDEIRLGLT

SEQ ID NO: 3645 - protein, 252 aa, M.catarrhalis
RCIMAGHSKWANIKHRKAKQDAAKGKIFTKIIREIVSAAKSGDPDPANNPRLRAVLEKANAANMTKDVIKRAIERGAGGGDNDNMEEITYEGYGIGGVAVIVETMTDNVNRTVGEVRHAFSKNGGNLGTSGSVAYLFSKRGEIIFHDLSLEDSIMEIALEAGAEDIENDGESLLVITSPADFGTVVDALIAAGLTPNSMEVTMSPSTTADIDNIDDAQKVLKMIDMLEDLDDVQEVYTNVNFSEAVMASLDA

SEQ ID NO: 3646 - protein, 85 aa, M.catarrhalis
CMNIISLFSGCGGLDLGFKKAGFNIAVANEYDKSIWATFKANHHNTKLIEGDIRHILEEDFPNDIDGIIGGPPCHVVRSGCFAWY

SEQ ID NO: 3647 - protein, 71 aa, M.catarrhalis
KRIFQTILMALLVDRLVTWSEAGALRGINDARGQLFYDYIRILKNKQPKFFWQKMLAVCLLIDIQTLLKVF

SEQ ID NO: 3648 - protein, 518 aa, M.catarrhalis
NKGILMLTPYVRTILQATVYDVAIHTPLEPATKLSKKFDNHIRLKREDLQPVFSFKLRGAYNKISQLSDAQKQKGIICASAGNHAQGVAYSANRLGINNLIIMPTTTPDIKVQAVKSFGGTVYLHGDSFDEANRFAMHKAETDGMTYIAPYDDELVIAGQGTIGLELTQQWRNIDYVFIACGGGGLLAGVAAFLGEVAPHIKVVAVEPEGAACLKAALASNKRVRLPQVSLFADGVAVAQIGELPYQIAKLSKSDGSGTVIEPEIVTCTNDEICAAIKDIFEENRSIVETAGALSVAGMKKFIQTHNLSGKNCVAIISGANMNFDRLRYIAERTEIGEQKEAIFAVQLPEKTGAFLDFCRVLQGRNITEFNYRMDATNPNTAHVFVGIGLKEGQKERILISDTLVKNGYTAYDLTDDEAAKTHIRYLIGGHANLADEQLFRVIFPERPGALLNFLEKLGQDFNITLFHYRNHGAAEGRILVGLQASHSNSRQILDALTDIGYECQGLTEDVGYQLFLK

SEQ ID NO: 3649 - protein, 127 aa, M.catarrhalis
TPLVATMTIPRSILFVCLGNICRSPSAEAVMRAKLTNFLPDVYLDSAGTAGYHIGNPPDPRAIATGESLGFELSRLRARQVSLEDFYEFELIFAMDDTNLSDLQTLKTTAMMHANGRDMAKPRTPDP

SEQ ID NO: 3650 - protein, 77 aa, M.catarrhalis
LTPWTTADPSSPVVKTQRAWAHDVQVMIEGPGHVPMHMIKQNMDLQLDVCKEAPFYTLGPLTTDIAPGYDHITSPVR

SEQ ID NO: 3651 - protein, 156 aa, M.catarrhalis
PHHITSAIGAAMIGWYGTAMLCYVTPKEHLGLPNKKDVKDGIITYKIAAHAADLAKGHPGAQVRDNALSKARFEFRWEDQFNLSLDPDTARSMHDETMPKEAHKSAHFCSMCGPKFCSMKITQNVRDYAKGLDVERGLQQMKEKYEEEGSKLYHEL

SEQ ID NO: 3652 - protein, 73 aa, M.catarrhalis
LMSVFSYFEKRLQGFPDISPPTHTHSVALFIYAWALGYQGWGIVDYSIHSQGRVFIGHMGLRGLGQMGDWGSA

SEQ ID NO: 3653 - protein, 252 aa, M.catarrhalis
MNIKTFSLAVICGLTTTAYAQSLPIDHDASLRLGVNATYNATAYHAKDPVFIMPQAFYDNNRWYIEGAEAGFYPYKDNKHHVRIGLTYDGQSFDPNHANAIELKQLNKRQWSALAHASYLYITPYGGLKAKAATDVLDRHDGQTVTLSHLSRFNKDAWTVYPEFGATWHSKDYNQYYYGILDAEALKTNHTAYQADSGWSPFVTATVNYQVTPKVSAFVNQRIEWLSNAQKNSPMTDNKIDSKTRLGLNYHF

SEQ ID NO: 3654 - protein, 278 aa, M.catarrhalis
FLFDVGFGRFVEQNKQINRVVNQSQFIPILIIDYILYLKSKSYIYPKNHLPSFMQMIFCFTCKCLSDCKAFAVQYPYKAKIDDLKFYDKIVANIVTNRYLKQCYQFGILLRSFIMKSSQKVIDYLNFLLGGELGARDQYFIHAQMYAEWSFGKLYDRIYHEMQDETGHAQLLIQRILMLGGKPNMQVGEIQIGSDVPSMLKSDLELEYRVQEHLKEGIALCETERDYVTRDILCVQLEDTEQDHAHWLEKQLRLIDLMGLQNYLQSVTAEVDQQGNAH

SEQ ID NO: 3655 - protein, 162 aa, M.catarrhalis
LGVIMKGNKEVIRALNLVLGQSLIAINQYFLHARITKNWGVHELNEVFYKQSIQEMKWSDELIERILLLEGLPNLQDLGKLLIGEDVAEILVCDLKLEKRKHDILVEAIGICEDHRDYVSREILVKLKDENEEYEDWLTTQQELIEDMGIQNYIQLKAQDND

SEQ ID NO: 3656 - protein, 473 aa, M.catarrhalis
FFTQNFEKSMNPHHAFLQALSNTLPTLSIKTDTESTQHWGRDWTVHFDTHCQAVIFPKTTEEVSVIVKLANEHQTPLVPSGGRTGLSAAAVATKGEVVISFDKMNQIGQFYEADRMVEVDAGVITQSLQEFAKNQGLYYAVDFASSGSSQIGGNISTNAGGIKVIRYGMTRDQILGLTVVTGKGDILTLNGGMLKNATGYDFRHLFIGAEGTLGFITKALIKLEKQPINLTAMVLGVTEFNSVVTLLAQFGQALTLTAFEFFDQLAVDKVIAAGHTKAPFESQAPFYVLLEFEAINDDVLDLAMGVFEQCAEEGLIVDGVMSQSIGQLQELWKLRESISETISAFTPYKNDISVLISHLADFISDIEHIVTANYPDFEICWFGHIGDGNLHLNILKPANLTKDEFFEKCQTVNTYVFDTVQKYQGSISAEHGVGMTKKPYLTYTRTQTEIDYMKAIKAVFDPNGIINPGKIFD

SEQ ID NO: 3657 - protein, 492 aa, M.catarrhalis
YNPKSRKICYNINNFDHKKRAFIMTSPIAQKSELLCPAGTFKNMQYAFAYGADAVYAGQARYSLRVRNNDFDEENLAKGIAYAHSLGKKFYVVVNIQAHNAKLKTFIEDIRPVIEMKPDALIMSDAGMIMMVREAFPNQVIHLSVQANAVNWATVKFWQQMGISRVILSRELSLKEIEQIIKEVPDMEVEVFVHGALCMAYSGRCLLSGYINKRDANQGTCTNACRWNYNTYKAVENETGDIVPANPEVFVPSQGEISNVNLNGDAVMDDDYVEKPSDEVVLIEEQGRKGELMAMYEDEHGTYIMNSKDLRAVELVPDLVNMGVHSLKIEGRTKSHYYVARTAQVYRRAIDDALAGKPFDTSLITVLDGLANRGYTEGFLRRHVHSDYQNYDYGSSKTDNQQFVAEVADISDERLTLTVKNKLMVGDTIEIMTPQGNVSYTLTEMWDKKGEAIDGALGSGWVCQIANPFKDMDKDVLKFALVMKSVSEAIYS

SEQ ID NO: 3658 - protein, 205 aa, M.catarrhalis
LSGDCYMQLKFMDFCSGIGAGRLGLENAGMCCVAHSEIDLNSDLTYQLFFNDYSNLGDLTQLNSDDLPDFDVMLAGFPCQTFSIVGKRAGLDDNRGQIIYYLTDILKQKKVSFFILENVKGLINHNKGETLNFILSLLLEAGYDVYHQVLDSQYYGVPQMRQRVYFVGIRKDIKHMPFKFPQPILSKPIDDFLMYRHAGDGRYTS

SEQ ID NO: 3659 - protein, 225 aa, M.catarrhalis
NYLMSTNTHILKEYFDPIKIREHQLGHTVTVGVSYHFTSLEKQGLSALLAKLPLVDEAPVAMDIDLSCFVYDKAFNILETIWYGNLRNANESIRHHGDALVGAKSFDDSLIQQEQIQIKLDKLLKEAHHLVFVLSSYHNQPLQKAKKGMLYFGDKETPKAFSISFDQIEPDCQSLAAWQLSCYRGDWELSAPMVDIKLTKLSDKSLDTLTNAVTTHIQSAQSKRW

SEQ ID NO: 3660 - protein, 510 aa, M.catarrhalis
GLIMKISTTARILTLSALAIGMAACSSIPKKIDTSAPILAVPNVPMKDGYQVYDADTISVAQAPSVASLRWQEFYTDPKLAALIELALQNNKDLQSAVLAVQSARAQYQITEAGSVPQVGSNTSVTRQANNRIDANASTNYHVGLAMSGYELDLWGKVASQKQQALHQYLATNAAKDAVQISIISSVAQGYVNLAHALAQRQLAEQTLKTREHAMMITQKRFEAGIDSKSPSLQAASSLESARLAVYAADTSILKAKNALQLLIGRPVPNELLPAIDASMHMGHITTQTLFSAGLPSELLYYRPDIMQAEHRLKAAGANINVARAAYFPSIRLSSNVGFSSNSLNNLFESSALGWSFGPAISLPIFDAGSRRANHEMAQSAQQSALVEYEKAIPNACKEVSDVLAERATLGLRLDAQIRLQEDYRQTYDSAYARFRSGLDNYLTVLDAERSLFINQQNILQLELAKLVSQIQLYQALGGGASLTAEQITEFNRQREAMRPAMLMDDEKSQ

SEQ ID NO: 3661 - protein, 221 aa, M.catarrhalis
TYYLTLMMTNKRISLAPMIDYTTMDFRAFAGFFNPNIHLYTEMISTSAILKGDAKHHLRCHPTESPVVLQLGGSNPDEMAKAVRVTEALGFGYCEYNINVGCPSDRVQHNKIGACLMAEPQVVADMVRAMKNETDKPITVKHRIGIDDCDSYEFMRDFVQTVAEAGCTHFITHARIAWLQGLSPKQNREIPPLRYEEVYRLKQDFPDLTIVFNTGLEGAAP

SEQ ID NO: 3662 - protein, 504 aa, M.catarrhalis
  UNSURE (501): Identity of amino acid sequences at the above locations are unknown.
NMLAFLIGAVMTITPVYTTFTPTKTPIKFFMAGLTFLIAHISHADDGRTDNQEPINQEIATLEPIINHAQPELLSHDALTPKIEPILAQTPNSAEDTLIADEALLLDNPDLLNHALNSAVMTNHMAGVHALLPIYQKLPKDHQNGILLGYANALAALDKGNAKKAIDELRRIIAIMPEYNVVRFHLARALFMDKQNEAALDQFNKLHADNLPEEVRQVVGQYRQALKQRDSWTWQVGMNLAKEDNINQTPKNTTQGQWTFDKPIDAITLSYQLGADKKWSLPKGAYVGANTQIYGKHHQNHKKYNDHWGRLGANLGFADAKKDLSIETYGEKRFYGHERYTDTIGIRMSVDYRINPKFQSLNAIDISRLTNHRTPRADSNNTLYSTSLIYYPNATRYYLLGADFYDEKVPQDPSDSYERRGIRTAWGQEWAGGLSSRAQISINKRHYQGANLTSGGQIRHDKQMQASLSLWHRDIHKWGITPRLTISTSLHHGAGRSRAIXELY

SEQ ID NO: 3663 - protein, 108 aa, M.catarrhalis
ETTMKNLTNKLLAGVLSAAVLLPAVGISTTAVANDRIKAQAYGDSNFAQNRQKAIQMLAARGYQVGDIEVDDFLGKPVFEVEAYKNGAEYDIVLEYPSLKIIKEQRDY

SEQ ID NO: 3664 - protein, 899 aa, M.catarrhalis
RLNITHVALANTTADKAVATDNTYLVVVLDETVVTAKKNARKANEVTGLGKVVKTVETINKEQVLNIRDLTRYDPGIAVVEQGRGASSGYSIRGMDKNRVAVLVDGINQAQHYALQGPVAGKNYAAGGAINEIEYENVRSVEISKGANSSEYGSGALSGSVAFVTKTADDIIKDGKDWGVQTKTAYASKNNAWVNSVAAAGKAGSFSGLIIYTDRRGQEYKAHDDAYQGSQSFDRAVATTDPNNRTFLIANECANGNYEACAAGGQTKLQAKPTNVRDKVNVKDYTGPNRLIPNPLTQDSKSLLLRPGYQLNDKHYVGGVYEITKQNYAMQDKTVPAYLTVHDIEKSRLSNHAQANGYYQGNNLGERIRDTIGPDSGYGINYAHGVFYDEKHQKDRLGLEYVYDSKGENKWFDDVRVSYDKQDITLRSQLTNTHCSTYPHIDKNCTPDVNKPFSVKEVDNNAYKEQHNLIKAVFNKKMALGSTHHHINLQVGYDKFNSSLSREDYRLATHQSYQKLDYTPPSNPLPDKFKPILGSDNQVICLDTQGHDHPQACNAKNSTYQNFAIKKGIEKYNQENNTKINYQAIIDQYDKQNPNSTLKPFEKIKQSLGQEKYDKIDRLGFDAYVELRKEWADWTNKNSQQNANKGTDNIYQPNQATVVKDDNCKYSETNSYADCSTTRHISGDNYFIALKDNMTINKYVDLGLGARYDRIKHKSDVPLVDNSASNQLSWNFGVVVKPTNWLDIAYRSSQGFRMPSFSEMYGERFGVTVGAGTQHGCRGLYYICQQTVHQTKLKPEKSFNQEIGATLHNHLGSLEVSYFKNRYTDLIVGKSEEIRTLTQGDNAGKQYGKGDLGFHNGQDADLTGINILGRLDLNAVNSRIPYGLYSTLAYNKIDVKGKT

SEQ ID NO: 3665 - protein, 173 aa, M.catarrhalis
TLSIVAFPMDYTQHWLITKLMLKEKPKTQLWQETNILFDAIQPSRNVVGLGYDAPSQKWGTNAIFTHSDAKNPSELLADKTLGNGNIQTKQATKAKSTPWQTLDLSGYVNIKDNFTLRAGVYNVFNTYYTTWEALRQTAEGAVNQHTGLSQDKHYGRYAAPGRNYQLALEMKF

SEQ ID NO: 3666 - protein, 65 aa, M.catarrhalis
FSHSWVIYIKAHHLRSFGIKLKINTHRHLFGTGISFPTFTSSPGQCAHIETPISTIYPIIGLGHP

SEQ ID NO: 3667 - protein, 62 aa, M.catarrhalis
GDDGIGYVDVASYVSRSMYSVAYVEYADDYVHGMSHVAVNAGAGECVQASGVSLVVAGAIDW

SEQ ID NO: 3668 - protein, 301 aa, M.catarrhalis
QNQGNSQMTTQNSALAARLSRQKRLDGAFVWTTKLSALLVLLTLGGIMLSLVFGAIPSIREFGLNFYTSSNWDPVASQFGALAPIYGTIVTSIIAVVIAVPVSFGIAVFLTELCPNFLKKPLGIAIELLAGIPSIIYGMWGLFVFAPWFGDTVQPWLINHLAGLPIIGQMFVGAPIGIGLFTAGLVLAIMIIPFIAATMRDVFLVVPDLLKESAYGMGATTWEVVTKVVLPYTKAGVVGGLILGLGRALGETMAVTFLIGNTFNINTSLFTSGVSITSALANEFPEGLHHEAPRSGHCRRR

SEQ ID NO: 3669 - protein, 60 aa, M.catarrhalis
AAPVFNQVLIIADTAGDCPMPAAAVIIVLECADNHDQVAGVVRFYVWANANGDQSSLDGT

SEQ ID NO: 3670 - protein, 477 aa, M.catarrhalis
YQAMTMTNFSAITISCFKAYDVRGELGVTLDEHISYRIARAFAQILKSQNTAEHPTIVIGSDIRPSSHSLKLAAIQGITDAGVDVIDLGMTGTEEVYFATSHYNTIGGIEVTASHNPINYNGLKMVRENSRPISADTGLAEVRALAESGNFIQSKKGSITQNTDKTAYIDKLMSFIDTSKFLPKKIVINSGNGSAGPVIDTLEVRLAGSPIELLKIHHQPDGNFPNGIPNPMIIANQAATRDAVIAHKAVFGVAFDGDFDRCFLFDENGRFIDGSYVVGMLAASFLQKYPKQTIVYDPRVIYNTQNVIKKMQGTPALSKSGHSFIKQVMRETKAIYGGEMSAHHYFKDFFYCDSGMIPWLLLIELLSVTGKSLAELVDDYIQDFPSSGERNFRLDKTNAATISQGLEQKYAHLNPQKNTLDGLSLDFGNWRFNLRSSNTEPLIRLNVEACGDATLLTQKTKEIIDYLQKQGAIATDH

SEQ ID NO: 3671 - protein, 294 aa, M.catarrhalis
LLYIITRKAMEFTVIILALVALVVFTIYKGVKMVSQGEKWIIQRLGKYHQTLEPGLNFIIPYVDAVAYKVTTKDIVLDIPSQEVITRDNVVIIANAVAYINIVQPEHAVYGIENYEHGIRNLVQTSLRSIIGEMDLDAALSSRDQIKAQLKHAISDDISDWGITLKTVEIQDIKPSATMQLAMEEQAAAERQRRATVTRADGQKQAAILEADGRLEASRRDAEAQVVLARGSEESIRLISQAMDGKDMPVVYLLGEQYIKAMNEMAKSNNAKMVVLPADILNTVKGLVGDKFKV

SEQ ID NO: 3672 - protein, 413 aa, M.catarrhalis
SQSSSLIRLICATIDKNFSQNQTMTALHFHLPTLSEKFTIAMIGFFAFLQVYSVQAILPVLMIDLKATEVQAGMAVGATVLAIALISPFMGMLSDAVGRKPFIVSSLLMLALPTALIGMASSIHEVIFWRFLQGVSVPGITVVLIAYISEEYSSRLTTMMSLYVSGTVLGGFSGRFFAGHLEHFIGWRYGYIVMAICTLIGAIWAYKSLPRSQNFTTPENFRTAFATLFSHTKNLHVICSGFLGACVLFSLVGCFTFINLHLSESPYLLTPADLANIFAIYLIGMVITPLSTRVVIRFGMTSTILLAILVSITGLLMTLFMPLGIVIMGLTLMSSGVFITQSATISYLTSHVSEGRSLASGLYYMGYYGGGFIGAWACALAYAQGKWLWTVGLILVVQLIALGVVTLFMRKHA

SEQ ID NO: 3673 - protein, 362 aa, M.catarrhalis
FMSPTTLPLPWQPPVLHADFKSTPNDFIVTEILDIEHSGNGEHLWLHITKINLNTTYVVKLLANWASVPMRDVGYSGLKDRHAITHQWFSIRLPTKAIPKTSLENFAKAYLNDDESFILNHLIWHSRKLNRGTHKYNHFAIRLRHLNGDINTIDETLERIKSGGVPNYFGEQRFGIDGKNLDKAHSFFESQLMSDQPYRPHKKFAEKDGLMISAARSALFNAMLGKRVADGTWNQALLGDVFNLEGTGSIFQNMPTDDVKTRIKQCDIHPTAPLIGIGDRRDCGSVRMLYDTLLNHHHNQTLYQGLIKIGAKLAYRPLRLMVYDLTWNRSGDELYLEFRLPKGAFATVVISMIAQEYQSKDS

SEQ ID NO: 3674 - protein, 170 aa, M.catarrhalis
FLGANHRCECQHDFGAIDLGRLIYLAKKTSKISCSNHQKPRQISQMDKFVTLYQTLSTSPFLLLMLLMGVFELTIWARTRFNQPLINPTLVTTIGGILILKFANIKWQAFEQASSYITFWLQPVVVCLGGAFVYSMAKNSCAVVADFGVSICGKSCWYRLWCVDCTGVGW

SEQ ID NO: 3675 - protein, 447 aa, M.catarrhalis
LNNQPILPNYSIKMLKYSLLISKTSRKNDMAQTQKMVLIVGGGHVGLSFALLLAHHGIKSTLVEHHRYPTIEPDEDNARTQYLDSRNTALSRRTVQIYQEIGLWTYLQSHACHIDQVNISELGSFGHATLNKDEEGVESFGQVMENAHLGRQLLLAVKDSPLINLYDGASVIDIAQDEAHASITVKFDTGQIKTLTAPLVVACDGQHSAVRQRLNIGVDIHDYEQVGIVGVVQTDKAHKHTAIERFSEAGPLAVLPLTDGMGDGGTGQTAGYRRSVVFICPKGEEGRYLSDDEYYLQTLQTVFGTAAGRFVATGRRGAYPLTKVLVHRQVSGRFVIMGNAAHTLHPVAGQGFNLCLRDAYTLANMLAKAVAKEGSQVDLGQYDRLIRYENARQKDQKRVIKFCDTVVGSFCHPNPVMRFVRNVGLICFDKVPGIKPLVATYAMGLKS

SEQ ID NO: 3676 - protein, 69 aa, M.catarrhalis
PRCLRSIGLSDEHTPKNELLALKHNQELAPNHIDTENLSTLERDLLKDALQVVRQFKHHVSSQFNLHYA

SEQ ID NO: 3677 - protein, 73 aa, M.catarrhalis
LWSHWQADDKTVILFGKPNGGMVCLACLQFSYTFRCFKVSYIIATLMASFKASCLGRSGIPKDLIMPAMVKST

SEQ ID NO: 3678 - protein, 175 aa, M.catarrhalis
YTANHQRQVLEKATDIIFFDDNAAIIEAQDSIDTLYIIIKGMVKEIDASGEILALYHPSDSFDTRALFGQSYRHSFIAVEQSLLYAMPKTIIRTLIEENSEFGAYFFANIADKLKNQSDHRRENELAGLFTAKVRDAYRSYDELYDGSIGLIAATKIMQINKSKSLLIHHDGKSV

SEQ ID NO: 3679 - protein, 241 aa, M.catarrhalis
YMSEAITAPEDDLTVITTHARTKTDISHIHEFLGCRTSERWLNLACEHLPLLLQDHANCEKKAAGTAMNLIFRYEFHRTLQERLAQLVREEMLHYEQVLSLMKERNIDWYYLPAGRYAKGLLKHKRTHEPAAMVDVLIIGAFIEARSCERFGALSEVIDDEKLARYYKYLLKSESRHYEDYLMLARSITDDSIDERVAFFRDIECELIQSPDDELRFHSGTPSDTLMANGVPPIISSPNKL

SEQ ID NO: 3680 - protein, 201 aa, M.catarrhalis
STLCLRCVMFDKLIHHYYRRQLKDKRYEFLYDTHPDELVSFDCETTSLDISEAQIISIGAVKIRGNRILTSETFEILIKPEGMIQATNVTIHGLRPKDLSGGVKVDFAIEQFLQFVGGRPLVGYFLEYDVVMVNKFLKPMLGIKLPQPKNEVSRLFYAQETKTKYYDSYVDLTMAGMIKSLGMPDLPRHDALNDAINVAMM

SEQ ID NO: 3681 - protein, 192 aa, M.catarrhalis
IMSIKSDRWIRQMAESYGMIEPFEPEQVRYNAQGQKLVSYGTSSYGYDVRCANEFKVFTNVHSAIVDPKNFDDRSFIDIIGDECIIPPNSFALARTVEYFRIPRDVLTICLGKSTYARCGIIVNVTPLEPEWEGHVTLEFSNTTNLPARIYAGEGVAQMLFFQSDADDVCQISYKDRGGKYQGQTGVTLPKT

SEQ ID NO: 3682 - protein, 155 aa, M.catarrhalis
CVDIVRDGIDMQMMQPYAERFSGILAEFGYPPCLGKIMVNNPSWCQSVSEFKQTVGSWYKNPTPDHMMNLAIFMDAKSVSGDEALLKEVRTHLSGYLDSDVGMLMSFARAVNQFDEDGRGFFAQILGHKSTKWILKNGNIPCGAWHSCIGTQSKN

SEQ ID NO: 3683 - protein, 493 aa, M.catarrhalis
KALIMYHFPTPIYTANAVKDWQNRWVGLGNRSFGLMQQAALMMSNTLKAHLKPDSSICIWCGVGNNGGDGYLLGVYLSEYYHVSIYPALPAKSDDAVWAYQDVIAADLPILQSPIEADIHIDALFGDGLTHPLDDIWCTIIEQYNAIKGTKIAIDIPSGLHPDTGIPLPCATQVDMTLCLMAYKAGLFMGYAKNYVGCIINHPLIPTDVLLEPIAIINNRLPSLPNRTRHSNHLHKGGAGSVMVIGGSALMGGAALMSAEAAIQVGAGRVTVMTHPNHHTAIISKSPNLMLGHIDKIDQTQLTEMTAICFGMGLGRDDWAKSIFKKWLAILMTHHMPIVLDADALWHLANQPPSRLPDHCIGTPHHAEAGRLLGISATQVEADRMAAIIQLQNHYGGQWILKGANSLSIDTLGNISICTLGNAGMATAGMGDVLSGMLAGLLAQDATLPFAQIIALHARSGDILSQESISVDVNKMGNTAAKLLKTNAIPSDN

SEQ ID NO: 3684 - protein, 128 aa, M.catarrhalis
GYVMILKAIMIVFGCLFLGQLIVGLFDLLLPPSVVGLILLFLALQVGIVKLATIEKLAKVFMDYLVLLVVPACISIMQYLDIIRDDFWVLIIGVSVSTILVLLTSAGSYTWLRKLQKSHAQTTKNQGR

SEQ ID NO: 3685 - protein, 183 aa, M.catarrhalis
NLPISNGRRLNKPVAISPFGFSLWLCVWAVPLYIQWQKIPVQWLPILVSQFVASLVGIVSGVWIVRALGGSYDSMIATAAKSVTMPIAIEVTQALGGIVGITAATVLIAGVVGQIFGVWILYKSGMRLPMGMGLSLGSASHALGTVRSMQLGGRYVAYATLGLILNGIMTAFLAPVLVPWLVS

SEQ ID NO: 3686 - protein, 689 aa, M.catarrhalis
VLIVANRLIVKYKATMSKLNPRQLEALNHTQGPLLVLAGAGSGKTSVITQKIAHLIENCRIPADRITAVTFTNKAAREMKSRVQKILSHEKSRGLTVSTFHQFGLQFLRYELKHTSLKPNFSILDADDCQRLLAELMVRDNLSGAERRELVHEAIKKISDWKNDLIAPKDAAETLDDPEDLGFVHLYELYERNLRAYNAVDFDDLIAMPVRILRESHEVKDKWQNRIRYLLVDEYQDTNTAQYELIKLLVGRLGRFTVVGDDDQSIYTWRGAKPENMALLKQDFPNLEVVKLEQNYRSTNHILGAANAVIANNEHMFEKSLWSDKGDGEKIRVITCNNDFDEAERVAKEILTHRLRNNQTWDKYAVLYRSNFQARALEAQLRQLEIPYKLSGGTSFFARTEIKDLMGYLRIIINPDDDAAFLRVINTPKRGIGSVTLEKLGLFAQHCGTSLLGACTRAGVKDALGAKAGAIIESFGEFINYYTHQLHDNSDPMPLVRQMITETGYIDYVKESSKNPQQEKGRLDNIEALYLSIAALINRADDEHDKTIDAVIRKMVLLDMLEQQQEEENTNKVNLMTLHAAKGLEFDYVYIIGCEEKLLPHVNSIMSANIEEERRLMYVGITRAKSELTLLLCKQRRSGADFKAVTPSRFLDELPAEYLSGAVTKKEDPKKVAENYLANIQAMLAAKKK

SEQ ID NO: 3687 - protein, 184 aa, M.catarrhalis
IGLVTESAFRDAFIHSSGTLNPNDATHLWAHFDLVCADADDFMFSALLKMMNHRIQRVVVTANGDPIGVLEQIDILAFLSNHSHLIAEKLEVATNLDALTQVASQMNHTISALYANGMQAKQLAQLMQVLNSRLFEKAWQMIAPANLVANTCLVVMGSEGRGEQVLKTDQDNALILSVMALICK

SEQ ID NO: 3688 - protein, 102 aa, M.catarrhalis
GKKVVMSDIYFERQHGLDFESARTKAQAWLQEAENQFGLNINYIKGNNQDNASIHKAGVDAQATLTADKITFQAKLGLFAKPLKGVISSGIKEGLDNYFPQS

SEQ ID NO: 3689 - protein, 153 aa, M.catarrhalis
TVWQNENFNCLDNRMKAQQGFTLIELMIVILIIGVLAMFAIPQYQKRVVTAQVNRVMMETSQLRTAVEMCLLQGLNAENCKADTINSDLMQGNKPTVTLPNESNTESTIKTVFGGNAASALHNKQLTWKHSSEKGWKCETDVDDDFRPKGCSK

SEQ ID NO: 3690 - protein, 883 aa, M.catarrhalis
FKRGYAMSQMLTEYRAHVAEREALGVPPQPLTDVQTADLIELLKNPPQGEEEYLIDLLENRVPAGVDQAAYVKAAFLNAIVKGETSSPLINKERAVYLLGTMLGGYNVAPLVELLDDDELGEMAAKALKKTLLVFDAFHDIEEKAKAGNANAKAVLESWAEGEWFTSRPKVPEEMTITVFKVTGETNTDDLSPAQDAWSRPDIPLHANAMLKNEREGIHPEKNGEVGPLTQIQELLDRGHPVAYVGDVVGTGSSRKSATNSVLWFFGEEIPHIPNKKDGGVCLGGKIAPIFFNTMEDAGALPVEIDVTEMNMGDEITLKIDHANATVAAFKDGTQIAKSKLKTPVLLDEVRAGGRINLIIGRNLTSKARESLGLEPSTLFRTPEQPADTGKGFTLAQKMVGRACGLPEGQGIRPDTYCEPKMTTVGSQDTTGPMTRDELKDLACLGFSSDLVMQSFCHTAAYPKPIDVVTHHTLPDFIMNRGGVSLRPGDGVIHSWLNRMLLPDTVGTGGDSHTRFPIGISFPAGSGLVAFAAATGVMPLDMPESVLVKFKGKMQPGITLRDLVHAIPYYAIQAGDLTVEKKGKKNIFSGRILEIDLTEMENDLTVEQAFELSDASAERSAAGCAITVSEEKVAEYLRSNIVMLKWMIAEGYGDARTLARRAENMQKWLDNPSLLKADADAEYAKVYEIDLADIKEPILCCPNDPDDAKLLSEVAGDKIDEVFIGSCMTNIGHFRAAGKLLQEVPAGSLTTRLWIAPPTKMDERQLMDEGYYNTYAQAGARTEMPGCSLCMGNQARIAPNCTAVSTSTRNFPNRLGQGANVYLASAELASVASVLGRLPTVEEYMGYAGKLESMEAEVYNYLNFDQMGEYTGRADRIDVAQLN

SEQ ID NO: 3691 - protein, 703 aa, M.catarrhalis
GLLTAQNVMTDELAERVNTASPKFELEEIYQPYGPRSRSVAARAKLAGLEPIAHAVLAGQSPAEALEGYVSPETLTDDKGETFEADFGDFDKQIVGIQAIILDEWATALDLLDKVRTGFNATASIRSELIGEEKREVGEKFKDYFEHTEPFAKLSNHRLLAMLRGRQQNVLVLHVDGEDEPFIEMIMRHFEIDPKAANGEFLTETAKKLWLVKWRSQIEHRLLTERRLAAEADAIAVFAENLKHLLMVAPTGRKAILGVDPGYSHGVKMAVIDGMGEVLATDTVYPFKPHHKLAEAKDRIETLIKTHQVELVAIGNGTASRESEELVKSIIREASLSTQALVVSEAGASVYSASEIASQELPDLDVSVRGAVSIARRLQDPLSELVKVEPKAIGVGQYQHDVNQTELESSLDKVTEDCVNAVGVDVNTASPAILAHISGLNKNVAQQIVEYRRAHGAFTNREALKNVPRLGVKTFEQAAGFLRIKEGDEPLDATGVHPESYGLVYEILTQHGKSLDEVLGNESLTKALNDSSDNFSQLATVLNELAKPAHDPRGEFRTAKFRDDVNEIKDLKVGMTLEGVVTNVTAFGCFVDVGVHQDGLVHISELSDGFVTNPADVVKPQDIVTVRVISVDEVRGRIGFSMKSEKSAKANQSAKADKADKSANHKPKADRKPARQDKPKSTAKPAKTMGSFGALLQQAGLGK

SEQ ID NO: 3692 - protein, 225 aa, M.catarrhalis
RPIAFATALSACSQPTAGTEQTTALSTQNAQETQHAAHAHHDTSMPMAAHTSEYMQSMNTMHDAMMAAATKAHADVAFVEGMIPHHQGAIQMAQIELKYGKDAAMRKLAQDIIDTQQTEIEFMQNWLTTAQDKDAIDANSEHAKAYLSDMSIHDAMMTGVHHEDADIAFAQGMIPHHQGAIQMAQIELKYGKDAAMRKLAQDIIDAQNPEIALMKQWLGSRGISQ

SEQ ID NO: 3693 - protein, 264 aa, M.catarrhalis
ITLSLAMKKLYDEKKVVYLQSLSCHPIFATTNKKLSISAATIHYYPKGSLIYLQYAKVRYLYFLLEGAIHCYRQQPNGQESLINRFDTNKTHIHQVQMINESLPNLKVDKCDEKQDEMLAYNQYNSFGKNSCHQLTAKASQNSYVAILPIHEIKKTFNNSSLATIFTWYAEQMYEQISTQFLLYDLLSLKTAQAKVAYYLLCHADNNSKIEISMSQKNLASLLSIRAETLSRTLRSLINQQIISVNGVQYTILKSEHLEQIVEQ

SEQ ID NO: 3694 - protein, 81 aa, M.catarrhalis
FKISKLKFASCSKILDLSALTVGDFEITPQYSGIDLAMFAVPIFSAIFMISSLSLVIKGRKINVDDAASIALRLVNVWLAT

SEQ ID NO: 3695 - protein, 239 aa, M.catarrhalis
SFLSRFGIIMNLTLSPDEMAVIKLSYQIASVSLLVNLLPAIAMGWLLARKDFFGKSLFETLVFLPLVLPPVVPGYILLVLFGNQGIIGQYLSQLGFDLAFNWKGAVLASAVMGFPLMVQSVRLAIELVDKHLELTAMSLGASRLQAFFQITLPLAGAGIVIGAILSFCRSLGEFGATITFVGNISGETRTLPLAIYSLLQQPDSDAQIMRLLMLSVGVAFSALWLSQWYARYQKRRLAQ

SEQ ID NO: 3696 - protein, 142 aa, M.catarrhalis
ISQSVFASHAGSVAAVNGWINGCMSDVLMSSFSYHVAVGSTMSEYKHVLDILKSKVVTKSILPVGAFSTKSISLGLKPVCTVSSPNKPFFVPNKYLSMYSCPLPDEPSKFDRQINILRGKFCGLSGCSAAKRNDPLCRLSTT

SEQ ID NO: 3697 - protein, 259 aa, M.catarrhalis
QRRPNHAIVDVVGWGGVFGIMVVAVVCPLSKKKACTMTQTAQTQTAQTSKDNPLIFDCQFQLVLGRLDLSVDLQSSQPVMGLFGISGSGKTSILHTIAGLNAPKNGSIRINGQTWFDGEKKINIPIQQRRVGLVFQDAQIFPHKSVMNNLLFGYHNIDDDQRRFHPDEIIELLKLGHLTQRMPTKLSGGEKQRVTLGRALLYSPNLLLLDEPLSALDSIHKQEILPFFEQIIRTTHIPMLYVSHDKSEIQQLTDEIYYL

SEQ ID NO: 3698 - protein, 266 aa, M.catarrhalis
MTSATDMKLLKVISLLMDYPEHELFIDDNLDQCKQLVMQSRLISPEVRQDIATLIDQMAALGELEAQAKYDSLFERGRSLSLWLFEHVHGESRDRGQAMVDLMAQYDMAGFEINAKELPDYLPMYLEFLSHQATINHDEMQIREEIANISHIVTLLAARLMDKNSHYVGLFKALLQIAGEPLSVIDQQLAKMHKDNQPADDTTEAIDKAWEEEMVDFLGAEQQNCPSNQTKQRIANLQGEHVQRQAEVPVHWVDFNQSAKATTQGV

SEQ ID NO: 3699 - protein, 223 aa, M.catarrhalis
LIYAKTKSTLGVCMHVTLSDLLNNNQYWAQSLTARDPDYFPRLSKAQSPKYLWIGCSDSRVPANEVVGVMPGELFVHRNVANMVVSTDMNLLSVLQFAVDVLRVEHIIVCGHYGCGGVKAALSQQEYGLIDNWLRPLKGMRYQYREAFEGLTDKEELDLLCQINVKRQVTNVCHTTIVQNAWYQGRQLSVHGWIYDMNSGLIEDLGVSISNAQQLASAFIYSH

SEQ ID NO: 3700 - protein, 677 aa, M.catarrhalis
EPDYNQSFFTQTADLGFLGVCMLNNRLSGFLPKSLSVRAWLAVGVIVFFATVTASTSAVLAWVSKSDAQALNSVGSIRMATYRINYLLTTNTTLPIDDHVKLDPTLSINQQLIDDMQARLNVLYAYQNMPGNKDTEIDSQTKTIQHHWLKMLKPALVNNDSTAVLVASGKYIKEVHELTKKIQVRSETRQHWQQVLQMSALGIILLTLLLGMYELRRNVLRPIHFLIDSTQHFRRGHHVPALVTGYQEFQTLSNSFNDMADTISEHQAKLNQEVLNKTRHLTQANQLLKLLYDFSNQLNQEPVTLSKLHHLLENFSKINPSFGFTLCLHDHLKLNESSTSGPLLKNDTVLVSSKDSISIHSHSVEELQTGKTDLLSSEICSTGNCDQCALKARSTTRIYPISAQNNYWGELMVHQQSEEDDTTITKELVQVLVSLVSLVFTIQKQRQQEHQLILLEERNTIARELHDSLAQSLSYLKIQLSMLGTHARQLSDAAQQNQNDTLMDHNEAMLQVLGQARSGLDAAYIQLRELLVTFRLKIESGSFDNAIEQACDEFSAKGGFNITLDNRILSQNLSANEQIDLLQIIREALSNIQRHAYAKEVTVSLYQKTHLDTEQRIYLEIGDDGVGLPKHIDEQQHHGLKIMQERTHSLGGEFDISQNTPKGTLVRIWFLPKFYEN

SEQ ID NO: 3701 - protein, 187 aa, M.catarrhalis
IMSYDKDIEFQGAEILSFLKKGMIEDALILFDKFKENHCIFDISESSKWNWLHQILLSPSSDSYKTGLSVKYLINQGIPINAQDVYGMTPLHYAMRSKNADAAIALLEAGADPNIPNKDGLRPLSMVGYTKDRLDVLELMLKKGGNVHNIMGDGSNRTILESWLPTENEEQWVFDIYNLMKKYAQNF

SEQ ID NO: 3702 - protein, 180 aa, M.catarrhalis
IMSYDMSGVEILDALCLGNITLAENLLKQHPQHNLLAVNSDKKNWLHKVTDSMNPDEPPPVTISYLINQGIPINAQDVYGMTPLHYAMRSKNADAAIALLEAGADPNIPNKDGLRPLSMVGYTKDRLDVLELMLKKGGNVHNIMGDGSNRTILESWLPTENEEQWVFDIYNLMKKYAQNF

SEQ ID NO: 3703 - protein, 269 aa, M.catarrhalis
FDTYPMMNTDTKPHPKTELCDAELMRYSRQILLDGWDIESQLKIKQSSVSLIGMGGLGCMVAPILVRAGVGEVHLFDFDTIDDSNLQRQLLYTQADIGLPKAQIAKQALIEQNSWAAVHSHNIALNDDTIKENLISIKSDLWIDCSDNFDIRQTLNHHSIITSTALLSLSAIGETGQVALFEPKKTGCYACLFGTSMRAAQNCATSGVLASTVAVIGALGADIALHFLGKDQNTLKDTLMVWQGSRANFQKMKFTKNPSCPICQKSIAL

SEQ ID NO: 3704 - protein, 139 aa, M.catarrhalis
QLRYKIMKNIYFIIKLFVLCSFAVIAYISIVLLSYESYYYCNDKNCLTFVETIKGRDLVVKVYDKRIYSRLQMKNSSYMEFYPEFIPYFEEDNNGGFIVHSDSEPKIAIGDMSNIRFVLSGYECCGTPFYKLNYYMIIF

SEQ ID NO: 3705 - protein, 234 aa, M.catarrhalis
NHQYIMRQEMNTLPKFIGTLTTVRTGKIEPFVRGVSAINKIPIDGSMKVDLLGLDADEQAEHKFHGGPLKAVHQMPITTYDVINQAFGLNIPVGSLGENLTVITDKIPMDERSVCIGDIYQFGDADDCVQLRLVQPRRPCYKINDRLNTPNISSFVSHQGIAGWYYQVIKTGIIKPDLSVYLIERPFEYATLHTLWQIVNQKSKIDAATANQWLNIDCLESSWKQKIFNKTLRP

SEQ ID NO: 3706 - protein, 63 aa, M.catarrhalis
KNFQTPTKGVSMTTTTDRLDRLVNELFRKFEEMCKQRFEQETHKSQTDDIFTTELEGSALCVS

SEQ ID NO: 3707 - protein, 448 aa, M.catarrhalis
MNNQLKGGRRIDDWRPEDEKFWQNGGSRVATRNLFISIPALLLAFSVWVIWSVIVVRMPEVGFQFDKAQLSWLLALPALSGATMRLFYAFLVPVFGGRRWTTLSTASLLIPTIWLGLAIQNPETSFTTFAIIALLCGFGGANFSSSMSNISFFYPKSKQGMALGLNAGLGNLGVSVLQFVVPVIIGFSLFGALAGDGQVTESGKVLYLQNAAFVWVIPIAIMTVLAWFGMNDLSNAKASFKEQSIIFRRQHNWIMCILYLATFGSFIGFSAAFPMVIKQSFPEIDPLKVAFLGPLVGALFRPVGGWLSDKVGGACVTFWNYIIMTIAVIAVMFFLKNGNFTGYFAGFMLLFITTGIGNGSTFRMIPVIFRTMHERLHSPDAITQARKESAAVVGFSAGFAAYGGFFIPKMFGSGLGVNGTFLVLIAFYIICIALTWWYYSRRNAPYPC

SEQ ID NO: 3708 - protein, 332 aa, M.catarrhalis
DHDHMMIVKGRFEGLGGYPMSTQEDVLSLISGGFDSSVASHMFMRRGSRVHYCFFNLGGQAHELGVKQMAYHLWSRYSLSHKVWFITVDFEPVVAEILKTIDDGHMGVVLKRMMVKAASQIAQQIKIQALVTGEAMGQVASQTLTNLNAIDAASSTLILRPLITSDKEDIIKMAEKIGTANIAKSMPEYCGVISKSPTVKALKSKILEQEANFNFEILNYAIQTAKFSDIRDLNIHEKIVTAEVVQHITSQQVVLDIRMPDEVDDKPLKVDAAVITLPFYKLLSEFDQLDPTKTYLLYCQQGVMSRLQAAQLLAKGHHNVKIFKPSSPQSGL

SEQ ID NO: 3709 - protein, 145 aa, M.catarrhalis
RSAQVFRSWHNTNIIAFLSQILYIQYFDELSRIIMFICAYILNCLLSRYIGSNAHKTSNNGYNENMDNKIIIQNKESIHHTSLGECKFIILKTLSGDKKPQRQECSLCGNGTVFYYCCYYSVLLTEISFGGQFDNACQDTKLGQK

SEQ ID NO: 3710 - protein, 283 aa, M.catarrhalis
GITHRPWCQSLVSKSNAQTPQPQNKQEHVMTATIKSAIKPLFIAMMVMGATSAHADLTVYAAASMTNAVEDINKLYEKKYNSKVKTSFAASSTLAKQIEQGAPADIYISANTSWMDYLAKKDKIVSSSYKNLLGNRLVMITPKNNPVKTNIKIDKSFDIGNAFTGKLCTGNTASVPVGKYAKEALTNLGWWDTIGPRLVETEDVRAALNFVNRGECQLGIVYATDAKVVKNVQVINTFPITTHTPIVYPISMVKQSREAQQYYNFLQTNEAKAVYYKYGFSVL

SEQ ID NO: 3711 - protein, 194 aa, M.catarrhalis
PTGHLMCNLCNDPNHQPQAKKSDKPFTPLNIAVLTVSDTRILDEDTSGKFLVDSLVEAGHVLVDRKLTKDDIYQIRAVISAWIADERIHAIITTGGTGFYHRDNMPEAVGVLFDKEVQGFGEMFRYLSHGEIGMSTLQSRAVAGMANNTVIFCLPGSTGACRTGWEGIIKQQLDNRTRPCNFVPHLMRQNPSHG

SEQ ID NO: 3712 - protein, 258 aa, M.catarrhalis
KLCKSARTVWVASLISVKTPQRALWCVFGFYLNFMRTRNNMVLKIFTAANPARLLLVDDHPMLRRGLADLLSLEKDVQVIAEANHGMEALDILNQEIVDLVILDHTMPILNGIETLKKIRELGIQTKVLLFTVSDNSKDVQDALHLGVDGYLLKDMEPEQIITDIRKILCGELVISPSLAPILAQAMRKPVKTDSSHELTEREIQVAKMIAQGMSNKMIGNKLGIAESTVKVHVKHILGKIGLRTRVEIAVWAVGHYQ

SEQ ID NO: 3713 - protein, 71 aa, M.catarrhalis
FNEKICSKFLAAEQTGLTQTQFNDFINSHPDYFRLENVSDNMGHRNEKPGNGDLQDIINDINEIKRKRGIR

SEQ ID NO: 3714 - protein, 66 aa, M.catarrhalis
FNEKICSKFLAADNNTHTLNTARLTAGAIALLYDFDVDTAVRRWRIMLFTLIRVKRSKRIRIKQMR

SEQ ID NO: 3715 - protein, 200 aa, M.catarrhalis
HKMNWRLLSIIRLPIGRLRLAMVISLPSFHLSLEVNMAQKLHQGSSKISLSHEAAYHVAITDGFALLDTFIDEKKLKKGLLDDRCGALVTFEGWVRNHNNSRPVEKLTYYGYEALALNQGKLLISEACQRFKIENAIAMHRIGDLNIGDMAVWIGVSAHHRYPAFEACQWLLDAIKADIPVWKQEFYTDSNQSLWLSNNG

SEQ ID NO: 3716 - protein, 338 aa, M.catarrhalis
YATDSDTINDNISHKLAAGLTGCLSAKAAGNRCEAGSIGAVVGEMWGDYQVDDPNTLTQAQKDKLINQAKLIAGITAVFAGEDVNVAAGVAAEAVQNNALVKSDDIKNFYLHYNTFCSSGSSAACDAIIHQWKYVSYEHAGMTSQEIVAWENSVTQIIEHYNRQCKDNTCRNHLRSQKYRYMIEHAGTPEYLYQLESSLIAYIHGPMAAVTAAGHQISGSVVEAYNAVSRQSVRGGSRTQVNNSAKAQKPLSNTSSNYQQTNKKAVEDLRQGVFPGKGEIGQPREMQKSTDPNKAADDFAQQFLGRKPTADDYKQGATMNNNNCQGCWRAQTPDGTPG

SEQ ID NO: 3717 - protein, 196 aa, M.catarrhalis
AMSLCAVLILAGGESTRMGQPKAQLALPNKSTVLDFHIACAKKLNLPIFLADNGKNSAHDPLITPLKDYLPCNDSGKGAGPLSGITAGLQAVESEGYILTVSCDHLLAIDKIADILKFTSAQVGYLYAKKDCPLLGVYHTSILPILLDFLAQGGRSVMQFLDLVDRQTFDLNDDLHSLTNFNTPSEFALALENFYD

SEQ ID NO: 3718 - protein, 66 aa, M.catarrhalis
KMTLCLCHLKIALVFTVTLLKNCKQAKPIFCRVKFVLQATAINALLKPDLRQEFIQSAPKTTTGAS

SEQ ID NO: 3719 - protein, 91 aa, M.catarrhalis
GKACTVKQDSTALVGAITVNTMITLDHIADNAFGNQGAVCGGLIALNIDGGVFGGVNLTVVDNQIAVSLDLDVGLTGDIGMVKCLLAFSKA

SEQ ID NO: 3720 - protein, 134 aa, M.catarrhalis
MVMCRLCHRQKQDCEAGSIGAAIGEMVGDWLVTEKLKQGIESGEIKLGSDEYNKLLNTVKITASAILDIPYDDFQKASGSLHAGGILGLIRHKTTGCTYGTHPRYGEIDYQYLRSKYGYDFKIKNGARNSTYKK

SEQ ID NO: 3721 - protein, 77 aa, M.catarrhalis
NFDRDVRKIKLTTNLVEVLACLSRSEALPAKYKDHALTGNWQGWCDCHVANDLVLIYKIDDGILHLARLNSHSEVFG

SEQ ID NO: 3722 - protein, 521 aa, M.catarrhalis
AVARSRKIKMKIRSQVGMVLNLDKCIGCHTCSVTCKNVWTSREGMEYAWFNNVESKPGIGYPKEWENQGKWKGGWIRNADGSINPKIGGKFRVLANIFANPDLPMIDDYYEPFDFDYQHLHTAPIGEHQPIARPRSLITGKRIQKIEWGPNWEEILGSEFAKRRRDKNFDDIQADIYGQYENTFMMYLPRLCEHCLNPTCVASCPSGAIYKREEDGIVLIDQDKCRGWRMCISGCPYKKIYYNWKSGKSEKCIFCYPRIEAGMPTICSETCVGRIRYLGVLLYDADKIHEVASLSNEQDLYQAQLDIFLDPHDPKVIKQALQDGVPMSVIESAQKSPVYKLAVDWKLALPLHPEYRTLPMVWYVPPLSPIQNAAEAGQVGMDGLIPDVDSLRIPLKYLANMLTAGDEEPVRLALKRLLAMRSYKRLQLVEKQDAQEVLDAVGLSVAQVEDMYRYLAIANYEDRFVIPTAHREEALSDAFAERNGCGFTFGNGCTGGNDTHMFGQKKNNKRDFIKTVQTWEL

SEQ ID NO: 3723 - protein, 174 aa, M.catarrhalis
CGYSGKAVENNAVYINKGKAIEADQNKANEMTKDIISNRNAGWRFLRSKRQADLLYQLNTSKDLEVQVDVNDLGELKITGDLWKTLPDGRQTIIVRPTTYNVWAVTGSLTLVRRTDGTYGVFNGTYDFEMHNSGILAIPRNIETVVGSPRCAATSGCTGYQIKFNGNFDKNKIK

SEQ ID NO: 3724 - protein, 91 aa, M.catarrhalis
IKLGGNLIMSNNLTVTVLYFASLAEQAGIDEEILTTSHYYLNDIYSYLLDKYDFNLTQDELAVAVNHQIANWQTKVSNGDIIAFIPPVAGG

SEQ ID NO: 3725 - protein, 60 aa, M.catarrhalis
NGMGRCWAFGGVLDIHKHGESLNCYYDCRKSNLLIKSLFLKYHLIKNEIAFVWSLFHYLF

SEQ ID NO: 3726 - protein, 172 aa, M.catarrhalis
SIFINRQSRRTPMAISARNQLNATIKHIQSGAVNDVIKLSLTDGDELTAVITSESTKRLNLAVGGSVVAIFKAPSVIVATDDELILSSRNQLQGTVESITDGAVNAEITIKTASGTVISAIITSQSCQNLNLAVGSPVTALIKASHIVLGVNPWCQKVTPKPHNHRTNRSML

SEQ ID NO: 3727 - protein, 427 aa, M.catarrhalis
KEPIMTTKSTIVLISSTVAFTICFMTWMMFAVLGIPIQQALDLNETQFGLLAATPVLTGSLVRLPLGIMTDKYGGRIVFFVLMLATVLPIFLMGYADQYWQFLLLGLFVGLSGGSFSVGIAYVAKWFEADKQGFAMGVFGAGNAGSAITKMIGPAIIAVGASTAASAAEGWRFLPKVYAGIMLITAIGFWFFSYDNKTHRTASNATLASQLAVLKDKNVWRYSQYYSIVFGGYVALALWMTKYYVGEYGFSLQTAAFLAACFSLPGGVLRALGGWLSDKYSAHTVTWWVLWSSFLLLFALSYPQTFLTIQTVEGEKSFYIGLNAIVFTVLIFLLGIAFAIGKASVFKYLSDEYKDNMGAVSGVVGLAGGLGGFILPIMFGAAVDITGIRSSAFMIMFGVVWVSLIWIYLSEVKPKIEQDHQSKTLKL

SEQ ID NO: 3728 - protein, 442 aa, M.catarrhalis
AKYISWLIYYKFIKGKHMISVDELQKSIISRVDEYLNIDNPLVSRQRVVLALNDALNHILAVDINANLDIPRQNVSAMDGFALVAQSQLQQGDGFTVIGESCAGTPFSGEILPNQAVRIFTGAVVPEGCDTVVMQEHTTFDQINITDKSQPYYIVLTKPAKASANIRYQGEEIAQGDTLLSAGKRLNPSDISLLSSMGYDEIEVFSPLRIGLIATGDELVSIGQPLSDLAQIYNSNTPTLKALLRKLPIIIKDYGIVKDVFDETYEVVKCAIKECDIIISSAGVSVGDYDFLTEVVRSLGKINHYKVAMKPGKPFVFGEFAADARKVLYFGLPGNPLSTVVGCINFVRPALWQALGAIDAPLTLHLPAITTANIKKSVGRREYQRGYFEMGEKKLQVTPSSAQDSHRIKQLSQANCLIVLDENSVGANKGEQVIIQLFDWVV

SEQ ID NO: 3729 - protein, 364 aa, M.catarrhalis
VIVMKNSLLFQPAQPAHQATDCFDTVFYGNEFTLATSNSTEKLTDNFQRKLTYLRLSITDFCNFRCNYCLPNGYQGKRPNNELTQQEIATLLAGFAALGTTKVRLTGGEPSIRHDLPDLIRLIKNTEGIKTACISSNGYKLGKHLSAWHDAGLDKLNLSIDSFNPTTFHKITGYDGLPTLLRDIDKLLYSTSITLKLNGILMAHTAYDNLMAALDFVKDRPITYRFIEFMQTSDNSQLFFAEHTSSQHIKTYLIKHGWRAQMRATDGGPATEYSHPDYVGKIGLIEPYSPKFCDHCNRLRVSSQGQVHLCLFDSQNYDIRPYLTQGDTQGLIQALQALMPIKPEHHHLHSADSGMMYNLSLVGG

SEQ ID NO: 3730 - protein, 248 aa, M.catarrhalis
LQPIRQSHHTRSLIMNTTNPEDWLHVFLFGIYPYIALTVCIFGCWARFDLSQYTWRAGSSQMLSDKGMRLASNLFHIGIIVVLLGHFFGMFTPHFIYERIITAPQKQLMAVIVGGIAGIMCLIGLIMLIWRRFTNPRISHTSTFSDKMLLLIILLQLVMGLATIWSYPTHRDGALMLSLAGWAQNLAILRPVYAASLVEDAGLVYKMHMFLGTTLILLVPFTRLIHIISAPIWYLGRRYQIVRQKRSQ

SEQ ID NO: 3731 - protein, 157 aa, M.catarrhalis
GLTMRKYIGFFILFPLIFTIIVYSYKQIFFLGETRLNGDYYAIEMDNTFFEYLSLKNEKVIGAIINRTEYNNIHLIIYTEGKICDEPQGSMFEYFPNDIMYAILDNTGNLLAFNNIEDYHSYISLKNIKIGNLHINIKDLFKIEQANQAAKKSGCIY

SEQ ID NO: 3732 - protein, 102 aa, M.catarrhalis
IMTMTNLNIRIDDDLKNQAKVILDGYGISPSQAVKMLFLEVKMLFLELVATCKFPLSLSYQADYQPNAKTISAMHELDNGGGTLYANLDEFLAEHGDVANQA

SEQ ID NO: 3733 - protein, 168 aa, M.catarrhalis
LWKIFMTDLDHHTLTHLDANGDISMVDVSTKIVTQRSATASAQVIFPSNIYLAIKNTDGLTKKGSITQTAHLAGIMGAKKTSDLIPLCHQLPLDSVKLSFEYNDAKCAIVVTAAVKVAHKTGVEMEALTAVSVACLTIYDMTKAMSHDIIITDVCLLNKTGGKSDYVK

SEQ ID NO: 3734 - protein, 69 aa, M.catarrhalis
LSEITLANAEPLQPSQQAMVNGASFVIKEMESQVGFLPRPPPKLPDFPCAFVISETTTNLPRFLLKITR

SEQ ID NO: 3735 - protein, 65 aa, M.catarrhalis
KNEILDILDEKLAPPKPHNSAMIANVVKEVSGFCIAKPNQIVGISKDAVDSVVQRRPPKTGTKNA

SEQ ID NO: 3736 - protein, 385 aa, M.catarrhalis
VCCFGLVILQGFAPFQGVVTPFYWHGHEMVFGYALAVIAGFLLTAVKTWTNQPMPYGWHLGAIFGAWAVSRFIWFGLHVTPSIALFMAAFVFDMIFWGMTAFAVIKAVWAVRQKRQIGIITKLLLLGLTQVAFYVGVLINHHNTQQIALYFALYLVIGVVFTIARRVLPFFITKGISVNHDGTPNGMQLEQKNSDLLDRLNLFGFFGFIIFDLFIKQPMIAGVCALVCLMANLARLKNWYHHAIWQKPLLWSLIIAFFGMTISLAMFVLYPIATQLNWFSSVNIHTLGLHGLPVFGTGLMPIAMMARVSLGHTGRNIHQPPATVSLMFMLMILCGIFRVVLPLFFNDSYMPLMLLSQVLWIASFVIFCLCYVGILVKPRTDGLFG

SEQ ID NO: 3737 - protein, 75 aa, M.catarrhalis
VKCLLNRDTQNSKHHPSHKTYRKCNGRRDEYNGRFCCHDRLFLKDTKNRFYLDIKISPNKSALQKYTSYNKLKFF

SEQ ID NO: 3738 - protein, 369 aa, M.catarrhalis
RSMVNRLFILDNDFIIHIFIVTIIRGLMSVGTYIPTQQTIQNICADEHNDSAKLIKVLNIENLAQKSDNIRIMPTSKDLGRPSSDAQFIKQALDKEIFDSTNLIASSHQTLPNITVNGVAIDPKAVAAEVQYHPANSQEEALFLAAQALVMRELLRQEVIGCLGERAWLENEEATIAKLLEQQVIAKSPDKASCQNYYHANQVEFVSMPIMTLRHILLACPPQEGEERIELKKQARQLIDRLNQSHNRDSDFIEFACRYSACPSKDDGGELGVLQKGSTVPEFESAVFALPVGISINPIETRYGIHVIEVLQKQEGRQLSFEEAYPIIENHLKQQSFHHSLCDYLFELSQKADIIGIELKMNEQNIYRG

SEQ ID NO: 3739 - protein, 1739 aa, M.catarrhalis
NSKVLKQQGQSTMNRFCYRVIFNKNLGRLVVVSEITKAQGKSGNLGGGLGKKPTWLSISLMTKLAPLTIACWLGCSGSAFANVISDSQAPVFQRPIIAAAKNDRQQTVALVQIQTPVQGISHNKYTQFDVPNQGIVLNNARTGASTQLVGAVAANPFLKQGEAHTIVNEVRSSKASQLAGSIEVAGQKANLVIANPSGITVTGAGFINVHEATLSTGQAINKQGHIHHTVNKGAIVIQTPKSANVATQTTTNNIGLGGPNKNADLVNLYSKTANINAQVQAEYAITTVTGTNQISDVGQVTPITSNQTTTNTTKPTTAIDIKSLGGMTAGSISLVGTDKGFGVNQAGSLNAKQAITITADGKITHSGQSSVQQGVVSLKSNTAVGLNGSTSNKTTIWASKDIAMSAPTIMANHASLNSASNITLQAKQELGTNNTTIHAGKKIEAIVFDNPTPKNTNGTASFTNTTFTTQGALTTANLQGNLTHNQSIIDAAGNVSSFAKGQQTLDHTNITSQANIQIQANSDLIVNNSQINSAKHTTIYVQGNQTTTNSTLIAKGIVSDVVKGDHRINGNGTYQGGAVLLDSTSLTLNGRLIARTTKSPLLNSNKNAQVLNGSLSIQTDRALTLNSTNHNLAIGGDISLVSQQGKLTLQNTNPVTNGNQAHYTLNAHQGNLTLQGSEVQLQGVNLKSKNNLTVYATPSIVLMDGVKREFSNKNQSGSDQKRALEAKLDEAARLSLTTRADAFTNTKSRIENQLGILNSNSTGFIHTPTTLVSQAGDIGVYAKQGILSQGALLNAVSGNITLEAQGVLPFAYQQTTKSSQSGSSNQSDAETQTDKAASIILTGSQNRYEIGQDGNDHHRLLSFGSPSMLTAGRDIDIRATKAATDKQDETPTLVLQGTKAKANGAIDIRANHHLLLDVGIDFEYSYDKTTRKHGRWYRRKYTTTETTNEWVDADVVELTAGDLRLQTTGNNSNNDQKHHLDIYGAELNTTGNITLGASGNINLYATKDTHTTQQNNQTKKKFLGIKTGTSNSKYNFSQIAAVPASLSAQFISSRSKGDTLLEGTRFEYLKGAQISAGGKIRLLAALSELQTATQREDNWVVWQRTQGEGQHTQTAQLPSFTGTAAPMFEAQGGLNIQIPISEKDVQKRQLKDEIITLASQPQYSYLNDLVNRNDVDWQQIILTDKDWDYKQQGLTPAGAAIVAIAVAYATGGVGTALTSTVATATGSTTLGTMTSAAFSSLVTQASISLIDNQGNIKQTLKDLGSKQNIKQMTFAIASAGIGSKINQTLSKSLGVGDIANSHNFSHKISKGIANATSTALLESTIYGTSLEKSLIKNLRGEVANAVASEVFTDYVKPLDKDTLIDNITHKLAAGLTGCLSAKAAGNRCEAGSIGAVVGEMWGDYQVDDPNTLTQAQKDKLINQAKLIAGITAAFAGEDVNVAASVAAEAVENNTFAEMYPNEWDEIVNNTDGSYSLELHEAISRNKQYILIGTSFIPVVGDIQGFVEAQTVGDHVFATIGLIPGLGDVAQKAHKAKKAYDTAKSANDVKGMKSAIQEGVDVLKQNQGKAGTPVVSQPVSGVQAQRQIRSGQANIAGYTIDKNGRLHNNRGQFTSDPNNPRVSTNLIRPNLRAKLRRQVDANYIRLPNGNYQHKDTREIVISPTQYGHTYGREHRRLVLAAEQTGLTQTQFNDFINSHPDYFRLENVSDNMGHRNEKPGSDDLGEIIRHMNQFKRKRGIK

SEQ ID NO: 3740 - protein, 1271 aa, M.catarrhalis
LGVSIVASQLSSFYNNEESKMSHLLDQLRFFKRKQGEFADGHGEVRDENRDWENSYRARWSYDKVVRSTHGVNCTGSCSWKIYVKNGLVTWETQQTDYPRTRPDLPNHEPRGCPRGASYSWYMYSANRLKYPKVRKPLLKLWREAKAKHTDPVLAWASIVENPTKSAEYKSKRGLGGFVRSSWQECAEIIAAANVYTAKTFGPDRIIGFSPIPAMSMLSYASGSRYLSLIGGACLSFYDWYCDLPPASPMVWGEQTDVAESADWYNSDYIIAWGSNVPQTRTPDAHFFTEVRYKGTKTVAITPDYAEIAKLCDLWLNPKQGTDAALAQAFCHVIIKEFYLKSQSDYFQDYAKRYTDLPMLVVLEEKDDKFKAGRFLRASDLIDNLGQENNPEWKTIAMNQNGELVSPYGSIGYRWGETGRWNLENKEGQHNGDVDLTLSLKGSGETASVGLDYFGGDEHPYFTAAAGDAIQYKNIPCHTISLANGQTAKVATVFDLMVANLGVDNGHGGQNVTDDYNDANIAGTPAWQEKITGVSREKVIQIAREFAENAHKTQGKSMVIIGAGMNHWYHLDMNYRGVINMLMLCGCIGKSGGGWTHYVGQEKLRPQSGWAPVAFGLDWHRPPRHMNGTSFFYNHSSQWRHETVSAHELLSSHANKSQFPEHMLDYNIKAERAGWLPSAPQLNQNPLTIAPQAKAKGMSVQDYVVESLHNGSLRFAAEQPDNPQNFPRNMFIWRSNLLGSSGKGHEYMLKYLLGTKNGLLGDETVQTGFKPNEIDFVENAPTGKIDLVTTLDFRMSSTCLYSDIVLPTATWYEKEDINTSDMHPFIHPFTAATDPAWEAKTDWEIYKYIAKAFSRLCVGHLGTQTDVVTLPMQHDSADELAQPFGGTDWKSAGEKPIPGINCPLIKVVERDYPSTYAKFTSLGPLMDKLGNNSKGIDWDTKEEVQQLGQLNYRIHDDSVANTRPNMSSVVNAIETVLMLAPETNGHVAVKAWAELSKKTGRDHTHLAKASEHEKIRFNDIVAQPRKIISSPTWSGLESDKVSYNAGYTNVHELIPWRTITGRQQFYVEHPWIQAFGEQMQQYRPPIDTKTTQAFKKYQSNGNKEIVLNFLTPHQKWGIHSTYSENLLMLTLSRGGPIVWISEIDAQKAGIEDNDWIEVFNANGAITARAVVSQRVKEGMTMMYHAQEKLVNIPGSENSGTRGGIHNSVTRTILKPTHMIGGYAQFSYGFNYYGTVGCNRDEFVVVRKMANIDWLEGRADDELPRPLPTTLD

SEQ ID NO: 3741 - protein, 157 aa, M.catarrhalis
LNLFAMKILIDADALPVIAKELIIKTANRTQTMAVFVANRMTKLPPSPFLSYVVVGAGFDVADEYILQTVQPNDLVITSDIPLANDVLEKGAKVLTPRGEEFRKDNIKPRLNARDFMESLRGTGVLDPKSMGGQKPYSNKDKIAFAGGLNRLAHALP

SEQ ID NO: 3742 - protein, 405 aa, M.catarrhalis
TSKTTPKPRLNHDETMIEQWNREFVLQRLLALTLLVILIVLCFKVVRFFIVPALWAGILAYVTFPIYTFFHTKVRLSPSFSAFLMTFCISLMIGVPLIVGVFYLQHEVLSFVGMVIRRLQAGYLDLPSQIKDLPVIGQTIKDTLWEINKNPETTMEAVRAWVQSHLYYGKMAFDAVLKNLAKLGMALMTLFFFYRDGKSLVRQIRQAMRNIIGDRIDDYIDSVGATTQAVVYGIGLTALAQAILAGMGYAFTNAPNPILLTLITFVVALIPFGTPFAWGGVAVWLLSQGHTTEGIGLGLWGILVISWVDNLIRPIVISGATKIPFIIIFIGVLGGLTAFGFVGLFIGPVVLAIGLAVWREWISQHKNEIFINQASGFVVADGKALLADTNPTPSNKQQPNLTKDD

SEQ ID NO: 3743 - protein, 661 aa, M.catarrhalis
ILFNVANKETVMIDHLSFKTTKAKSLHTQNIAQRTLKAVAHTYRPLSMAIALMGLSSIATAQEFSQTVFFGDSLTDTGRLVQIGKNSLASSVFNQAQPSFTTNTDPVWSSILAKSYGHTADANDGTTLTGTNYAVGGARTKEDVVKNAPVPFFTIPLFTIPSAQTQINRYLTLNNHQADPKALYTVWTGANDLFEAAKAPTQLQAAEIITTAANDQANLVGQLGQAGAKHILVPSLPDVGVTPEYAQDPTKSATASLSAHIYNQTLYQSLNNQTTNVIAANTFALLKEAVSNPAGFGFSNVTEPACQNLDANLSSLACKPSDWQQTAANANETYAFADKIHPSGRTHRILAQYYRSIIDSPNQMGQLPQHLIKHGQQSQQQLVRRLDSLNNHQQSLWIDGSISNQSLDTRNKIDRPTIKLGLDIARPNQHTGAYLTYQQQDYHLSDSITADVKQTGIGLYHRHDFDHLRISANLGVDHLSTQSLRQIMWDGENRNHQAHATGQRRYASVQGSYGFTQNNVTYRPYVGIHAQDIKQNRFFENQPNLSTALSFKLPDHQSLQADIGVNIDYAMNDKLNLLAGLGYQHEFKDNNKTVETAVLSNRDYHRSFVTTVPFDKKHTTHAHLGATLALGNNTHLNAGIQANHQDHDTKVGGFVGAQMAF

SEQ ID NO: 3744 - protein, 274 aa, M.catarrhalis
HYHKNGRWTFITKAVIVAKFMGDWFMPIKPDLLQILYQDACMVIINKPANMLVHRSWLDKHETCFVVQTLRNQINQHVYPVHRLDRPTSGVLVFALDSQTAGLLAKQFENHHIQKSYLAVVRGIIGTGRIDYALKLRLDKIADKFSNPNKASKSAITDYQVLATTQQPFISCRRFDSSRYSLVCLTPITGRKHQLRRHMKHIFHPIVGDTTYGDKVQNRAVLAHIGVKRLLLHAHQLQFCHPLYDEMIRIVAPLDTAFCQVMTAFGWSDVDLMA

SEQ ID NO: 3745 - protein, 219 aa, M.catarrhalis
YIMNKTLFLFVPATRLDWVSKAKQSKANAIIIDLEDAVTDDQKNHARTALMALDAKGECDYWLRINAVHSMHHLDDITCMLKLNHLLGVVLPKCQNKHQVESVYHHIHKPVIAMIETAVGMANIAGIAHADGLWAMSFGRLDLMYELGVQPDSPASQLIFDKIRTDLLIHSVANGLHPPIETIFNDFEDETGLAACVRHWCDFGFAGQMMIHPKQIAVG

SEQ ID NO: 3746 - protein, 192 aa, M.catarrhalis
LIRLLFLRIIMSNTQHAPSPAPITSPTGTPKVGIIMGSQSDWATMSLSAQILADFGIPFECQVVSAHRTPDKLFDYAKTAKDKGLKVIIAGAGGAAHLPGMCASQTPLPVLGVPVKSSTLSGWDSLLSIVQMPKGVAVGTLAIGDAGAFNAGLLAIQILAIDDDALATKLDEFRQKQTQTVLTSPHPGIVNH

SEQ ID NO: 3747 - protein, 89 aa, M.catarrhalis
DHPDLTIDFKDSLTGAKLFTKGDVAALMTAIQDGDVKIMGDYKLVLWLAGIGKQAASIPKEYQGYIDAIKPYAKRTKGFFDGIKQKMTK

SEQ ID NO: 3748 - protein, 185 aa, M.catarrhalis
KKTEYYQQGNHAKAFEWYTKAAGQGHADAQYELGVMYGLGKGVLQDYQKAVEWFTKAANQGDAWAQKNLGVMYRNGQGMRQDYHKAFEWFTKAAHQGHADAQYELGVMYAQGHGVRQDYQKAFEWYTKAANQGYTLAQNNLGVMYENGQGVRQNKSTAKRYYGQACDHGNQLGCDHYRRLNQQGY

SEQ ID NO: 3749 - protein, 302 aa, M.catarrhalis
GKFCMMASEYAPTLTLMNAKKRAQMLQHIRAFFEARNIMEVTTPILSQAANTDVYIQSVQATFQGATGQTKGYLHTSPEFAMKRLLAAYQTPIYQICQVFRDNEKGHRHNIEFTMLEWYRPNFSLEALADELSELLSVVYQKPIHLTQISYAQAFVHYLGIHPFDDMSTPDILRQCAVAHNIHLDMGDDKQGWLDLLFSHLIEPKLGLQNPTLVINYPKLTAALAKTAVDADGYEIARRFELYIHGVEIANAYDELANSQELLKRFEQDNHERHRQGLPIMPIDHRLLAACDHLPDCCGHWP

SEQ ID NO: 3750 - protein, 352 aa, M.catarrhalis
LMLRVLADENIANLDDYLLCHQVELIKMAGRAIDRQSLITHQPDALFIRSVTQVTQENLGDLSNTPLKFIGSATIGIDHIDTKYLADHHINFANASGCSKHSVAQYVITAILHAHQSPKTNLRLGIIGLGNIGNTLARYAKRLGWQVFGFDPFLATDSINNASLDEILDCDVISIHTPLTKTGSHPTYQMLNAQTLAKIRPKALLINSARGEIIDESALLAAINQKQLSVVLDVFPNEPFISQQLLYALKLATPHIAGYTLEGKIRGTDMIYQAFCQTFNLPILQHFLALLPPNPYHFSMLLNHKNQQPLAWFYDIQADFKTLKAAACPHILGNQFDMLRKNYHLRREWIFD

SEQ ID NO: 3751 - protein, 330 aa, M.catarrhalis
QAKSRLRYKGIVMIYDIIGDIHGHADKLAGLLDKLGYIHDGISHIAPHGHQAIFIGDFIDRGNQQLATLQIVFDMLDNNQALAIMGNHEYNAIGYATPHPDGGYCRPHTSRNTKQHQAFLDEAPIGSDDYYYWLSRLYELPLWLELPELNIVHACWDTKAQAALAPYLTPDHRITQRGIIATAMSGSTEFYALERLLKGIESPLPAGVVLVDGHDIVRRRTRIKWWQKDWQNHPLSEIAQLGTRATMNLPSDLDIKPLPMDFELTTHQPIFIGHYWLDGTPSILSNQVVCTDYSAGMNGYLTAYQFDTKNPILSNENFVQYIHTADKSKE

SEQ ID NO: 3752 - protein, 147 aa, M.catarrhalis
FLMGETVFLYIKAFHVISMVCWFAGIFYLPRLFVYHAMSQDTTSIERFSLMERKLYRGIMTPSMIATWGFGLWMISFSPSLYLSQGWLHAKLLLVILLSIYHLACGKFRLKLAQNPHYKSHVYWRWFNEIPVVILIAVVILVIVKPF

SEQ ID NO: 3753 - protein, 403 aa, M.catarrhalis
MLMMPHIPNQANQENAMTNLFPQDWRFDTAQLKGISTDGKWLLPPLVDLCARLREPGHQSHGTLASEGRAARQNGFLHVVMPPDTSPVLENGSLLKGLKQKAWADGGIYLHVLGALSAGLEGKQPANLAGLKQGGAIGVSNTAAGFESDLVLLRCLEYAATFDIKVFFYPDEPSLSAGGVAHDGYIASFHGLQGIPWLAETIALSKQILMTEETGIHAHFSQITCRTSVELIRHAKQKGLPITCDVAMHQLHLTDDDIEGYNSHAYVLPPLRSNTDQQALIKGLQDGTIDAICSHHEPLSSSAKQAPFAQCQAGISNFDTFVSLGVKLVADGVLSTEQLVEKICLNPAKIAGITDYERIGGAVLIDPHQAWTVTKDTMLSAGKNTPFLGQTLMGRAEKVFFDG

SEQ ID NO: 3754 - protein, 347 aa, M.catarrhalis
LMKILISKEEIARLFELPLMDLLMQAQTVHREHFNANEVQISTLLSIKTGNCPEDCGYCSQSGHYRDKTGLTAEKRLEIKKVLAAARRAKSQGSSRFCMGAAWKHPSEKDMPYLVDLISEVKAMGLETCMTLGMLKPEQAKTLADAGLDYYNHNLDTSRNYYDTVTSTRTYDERLATISHVRDAGINVCSGSIVGMGESREDRIDWVYELTQMPIPPQSIPVNLLVPIAGTPLGDKVIAEGRLSVIEWIRTIAVTRICCPTSYVRLSAGRESLSDGEQALAFMAGANSFFYGDKLLTTGNQSTSHDDRLMAELGLTPSKPAPKPKIIDAMSGAVMTAEMPHNCPLSA

SEQ ID NO: 3755 - protein, 259 aa, M.catarrhalis
RQSVSADQCFGNRPRPIGRKGIVKPLNIDTVPFMAVNSLDELQTATNKLGLPLVLKTSRGGYDGKGQFVIKTQSDIATAWEELGDAVTGDGGLTDAPAPLIAEGFIHFSREVSIIAVRSQNGDICYYPLVENHHTNGILSKTIAPAANADHLTEQAQSNISKILSHLDYVGVLTLELCVSDDGLIANEIAPRVHNSGHWTIEGANTSQFENHIRAVLGLPLGDTGIIKPSVMLNVIGKYPDVSELLTHTGVHFHHYHKA

SEQ ID NO: 3756 - protein, 132 aa, M.catarrhalis
RPFFIKICDNIQNFLLIFWISFMTDSIKTIGILGGGQLGMMLAQAALKLGHRCVFLEDADGVPAALYGQVFKYNELDDFITASDVFTLEFENTPIKTAKSLASLEHKGSLFPPTNALEIAQDRLAEKVLLNR

SEQ ID NO: 3757 - protein, 101 aa, M.catarrhalis
SPPPRTRYKRGTLNQAIGKSKSGMSTKILALVDALGNLVSFTLLPGQRHDIVGVEALIKDKEFNALLADKTFDADWLLEELNERACQAVIPPRQARQAWQG

SEQ ID NO: 3758 - protein, 358 aa, M.catarrhalis
NNRTIMATFRKILNPISLKNLELKNRIVMPPMCQYSATDGVPNDWHLLHYTSRAVGGVGLIIVEMTNVAANGRITANCLGLWNDEQEQAFKKLVDSVHAQGAKIGIQIAHAGRKAQDEPNAVAPSAIHYGELDYAGQNLITPRQLSIDEIKALVQAFADSVKRAVNAGFDAIELHAAHGYLIHQFCAPKSNQRSDEYGQDRLLFGEQVIHAVRAVMPDEMPLIVRISAQEYGENGFDSDYGVEIAKRFSTAGADVFHISGGGDGVLCEGKHPEFYAGYQVALARKVKHATGKPVIAVGMLDDPAVADHVLGVGDADLVAIGRGLLRDPYWVLNAQYQQNRSDGKEVQFVPRQYERGFM

SEQ ID NO: 3759 - protein, 79 aa, M.catarrhalis
PKFAIIMYLQPKPKKPLGHPNPNGLIYLIHNETFIEKILKFTLATLGVLALVESPLGKPFRSVPLTANLHQRFCLPVKH

SEQ ID NO: 3760 - protein, 472 aa, M.catarrhalis
RCVARSDKNRDDKQCQRPCRMAKIQSGQKTLEKRFKDPDDPLKIVIVRDMWLTGFDAPCCNTMYIDKPMSGHNLMQAIARVNRVFRNKSMDNGGLIVDYVGLTDELEKAMKQYTNAGGKEKPVRNIETVLEKMLEYVSIIRGQFATPVDGQTVDIGKILQISEPAKLLNAILTSANHILALDRIYPDDSKDKKGKTPRKNAFLQAVRFAKKGYALCGALKAVEPYKQELAFYDAVRATIIKNSTASRNPSGKDRLLQLTVLMNRAVQSDGVVDLFDLLKKERPNINLLSDEFLETVKNSPTKDLWIGAMERYLVSELRTQSGANLATKKEFEQRLKEAMNQYHNHNLSVLEILEELIMLAKEFDARQKRGEELGLSPAEMAFYDALARNESAVREMGDAVLLKLAREITEKLRKSVTIDWQYKDLVRAKMRTLIRITLRTYKYPPDLQNEAIEFVLKQAEEIAEDLVPKETA

SEQ ID NO: 3761 - protein, 405 aa, M.catarrhalis
VEGYPMNNEELSSSYFDEIKEWQSGEPIFVSKNDEINSRIPLLRVNGWKKFIDLLSTNFFQENISELIFRGQRRYDWGLMPNIARNSDNGLFTKELMENQLNNFKKAIRGRIKDYTLLLNEDDDEIWAIGQHYGLNTPLLDWTYSPYVSLFFAFSRKDVKAEKPNEYRVVYIANKKLLSNFVTFVDPKVDMYGRLVNQAGLFIKAEAGKSIESLIVDSIAEQNGSEFLSDESFEQEIAKYLCKIYILNTPDIQSDCILSLRQMNIHHANLFPDLMGAADYCNLLSEFQPDNKNPKILDSSTLNHCESPTLANNEGSILTLTNNSSINNIKELLIPYLALPDTDLEQIANKLLNILKTNMVTDWQTRDEIKAKIKIAWRRILSQTNMNKEQIENMLDELFTLDFQP

SEQ ID NO: 3762 - protein, 232 aa, M.catarrhalis
IHYHNHSLFWSSTMQFFNKDDVLNAFHYRVSTRSYDGDKKIPAEDFNYILELGRLSPSSVGSEPWQFLVLQNADLRQKLKPYCWGIPTMETSSHIVAILAKKNARYDTPYFGEIMDRRGLTGDDRAKALEVYQKFQEQDIAILDSERSLYDWASKQTYIALANMMTGAAMIGVDSCPIEGFAYKEVNQLLADEGLFDPNEWAVSVMVTFGYRDKEIKPKARKTFEQVVKFVE

SEQ ID NO: 3763 - protein, 220 aa, M.catarrhalis
LYNHSNIKNGILKMIMKKHLFISVILALTLSLSGCGYNALQAQDEQTAAAWSEVVNQYQRRADLVPNLVQVVERYANHEQAVFSEVAEARARVGSVQLTPEALNDPQAMQQYQDAQGQMTSALSRLMMVSERYPELKADALFQDLQVQLEGTENRITVARNHYIEDVRTYNTTVRQFPTNLTAMVFGMKPKPNFSVENEAAISVAPTVNFGNNTNTGTAQ

SEQ ID NO: 3764 - protein, 126 aa, M.catarrhalis
LNCLHYQEPPAPPPPKLPPPPLKPPPPKPPPPKPPPPKPPLRPPLPKLPLPSVIGKTPRANKNTHNMTAAIITTKNPAPLISATITNPPAPKVAPKNLPRIAPKKEPAINAMINKPMMSISTESSV

SEQ ID NO: 3765 - protein, 636 aa, M.catarrhalis
IFSHKHYFHGESIMLGINENTIEQSAIATMQSLGWDYAYGKTILLGCQNEWRERTGEVILKPLLAAAIAKLNPNLPAAEVENVVAMVCRADTGDLAERNRGAYEWLRNGVPYRYQAQGEQKFEVVRLVDFGVPAHNDFRIVNQLDIGGKKGKRIPDLIGFVNGLPLVVFELKNPLKENADIGKAFAQLQTYKDEISDLFVFNQALVISDGIVARIGSLTADFERFTPWRVVDEKNKSQRIVFENELEGLLQGLMTPKNLLDYVQNFVVFERDNKNRTIKKIGAYHQFYGVNEAVECTLLASSHTGNRKVGVFWHTQGSGKSLSMLFYAGKVLSQGSLKNPTLVLVTDRNDLDGQLYATFCGGEALLKQTPVQVDGRDELRSALASRSAGGVIFTTIQKFGLMEDELSHPILNERQNIIVITDEAHRSQYGFSQKINDKGQYREGYAKHLRSALPNASFIGFTGTPIALDDKDTQEVFGKYVSIYDFEDAVKDGATVPIIYEPRQISLGESHDFDKVVKEAQTLLDDDEQNPTFRLREKLHGVESRLQKMAEDIIAHYDERTKQQDGKAMVVVMSRAICVKLYEKIIAIRPDWHSDDVLQGVIKIVMTSNASDPAEWQKYNQDKKRWKNALKTQTTP

SEQ ID NO: 3766 - protein, 83 aa, M.catarrhalis
LFFKPWFGCNNLLLASKKYTNKILFIFNTLAIKKQINISVDDKKPNPKVNNIRFTLELAKNSSMQIAKNIKKPKINETMNCFF

SEQ ID NO: 3767 - protein, 93 aa, M.catarrhalis
KIVKYIMKKCPNCHKKCIDVLEYSGKCPCCKEAIQTPVFFSAYLMIVLMIVMSVGAYINSYFLMTFAFLMIVIYKLFSYQIDLLLSPLMVKNE

SEQ ID NO: 3768 - protein, 206 aa, M.catarrhalis
KYPKLWTPKRSPRYCVQALPPTRPCVIGKSAKTPKWAWSDWADWDIWWSNLLMLWGRKLRSLPVRLANPMTLTAWGRAVWCCPPMKKMFEVANTFDVIIDTVPYTHDLKPYVPTLALDGTLVLVGLMGELEQTINTVPMIMGRHSISASVIGGIRETQEMLDFCAEHNIVPDVEMINMQDINTAYEHMQKSDVKYRFVIDMASLKA

SEQ ID NO: 3769 - protein, 188 aa, M.catarrhalis
WRWRQLRWWRCRRFLVMQTIQSTKSLARLFRQMVYIPSLHNRWLTKTVKTTLTQAIIQAELGHRGEIYLIIENHLPITNAYSQDCRERALYLFATHKVWDTEHNSGVLAYVNLCEHNLEIIADRGIDQKAHMDDWQNMCDDAVAQFRQGKMQIGLTTLITQLGKLLKLHYPSSDEMGNELSNQVTYLR

SEQ ID NO: 3770 - protein, 167 aa, M.catarrhalis
IPNGAKNQLYGSIEVDESYFGAKRQRGYHGKLKRGRGTLKQPVFEIFERDGRVYTEIVPDCTAKSLQAIILGKVSPDSVIYSDGWRGYNGLVDVGYAKHFRVNHSKNEFAHGKCHINGIESFWSFTKRRFAKFNGVSKNFEWHLKECEWRWKQNIDDLEKHLWLLLQ

SEQ ID NO: 3771 - protein, 460 aa, M.catarrhalis
RGWGFKMSDTQTRLDEIAELNPTRALKKGKMTSFVEMASLPTNSRDIENIAQKEFSGSGSKFKNGDILFARITPCLENGKTAKVAGLQHDEIAHGSTEFIVLSAREPEFDEDYLYYFCRLSEFRNYAKSRMEGTSGRQRVSWQALAEFEFDFPDKEIRKKAADMLKIFDDKIQLNTQTNQTLEAIAQAIFKSWFVDFDPVRAKAAALSEGKSEYEANLAAMSVICGKDTSELNDTEYKALWQIAEAFPSELVENIEFGEVPKGWENTTLSEICSMQNGYAFKSNEWTGSGIPVIKIGSVKPMIVDIESNGFVSEENEHIRSDFLLKQGDIVVGLTGYVGEVGRIPAGDKAMLNQRVAKFVPKKLDHELSYYNFVYCLARQRTFKEYAELNAKGSAQANISTRELLNYPICLASLEVHKFFEIKINELLYKILTNSQESKVLEKTRDLLLPKLLSGGLSNE

SEQ ID NO: 3772 - protein, 116 aa, M.catarrhalis
WHAIDMNRLMLSDAQWAKIEPLCAGKVTDAGRSAKDNRLFIEAVLWIIRTGSPWRDLPEEFGKWNSVFQRYRRWVKAERFAVIFEALRGDPDMEYAMIDGTIVKVHRHGQGTKGGL

SEQ ID NO: 3773 - protein, 201 aa, M.catarrhalis
  UNSURE (10),(16),(18),(39): Identity of amino acid sequences at the above locations are unknown.
ACDMTDIRTXDLTYLXAXVVLLDECNVSRSAQRLSITQXAMSGTLNRLRESFNDPLFVRVQHGMQPTDRAIELGHVARRVLEEISGMLAPPKLEPANLSMTLRIGAMDYVQQIIALPLILRLRRLAPNVKVALLPVQGQNIKTLFDKNAIDLALVGQHHISDDMPQMRLYEEHYVCVMSKMHPMANTALTLDEFCKLPFVF

SEQ ID NO: 3774 - protein, 116 aa, M.catarrhalis
IHEIIGRIAKVGDNAQKFKVGDLVGMGCMVDSCHTCSPCSYGLEQYCEHGNIGTYGSLDRHDGTLTQGGYSTSIMVSEDFVLKVSETLDTQAVAPLLCAGITTYSPLRHWKVGKDT

SEQ ID NO: 3775 - protein, 70 aa, M.catarrhalis
AVLVASMSMQKHCMIFLTLYLLNLLLYLMFLVYQIVSASLEPTHILDGYGCHMIYSGIKHLTNTSYRSQQ

SEQ ID NO: 3776 - protein, 371 aa, M.catarrhalis
LCVVKVMQKMHAHTQAIQRWVMAILLPILLIFGETAWASESVSEDDLTALIISANRASQSNPNSLLAESVREFEQAINPANQADTKPQSTPINIPTSHAQSISHDKLILNTPVVDVAKILTPSEYLHLTEQLHKIYQDNLAQAALVIVPSTDGIDIFDYALAVAERWQLGQADTDDGLLITVAVNDRKMYILTGYGLEGVLPDAALSRIIRDDITPAFKSGNYAQGLSAGIARIDERLRADPESLARADAQTDDSVDIDIIGLFIIALIAGSFLGAILGRFLGATFGAGGFVIVALMSGAGFFVVMIAAVILWVFLLARGVLPITDGSGNFGSGGRSGGFGGGGFGGGGFGGGGFSGGGGSFGGGGAGGSW

SEQ ID NO: 3777 - protein, 60 aa, M.catarrhalis
VGVVGLGGLGYMVVKLAHAMGAEVTLFTRSLGKSDDAYCLGASRVVLSTDEKDVRGGEHL

SEQ ID NO: 3778 - protein, 554 aa, M.catarrhalis
RHLSNRIFIMPNAQAINQDFLNKLDQDLWKAADTLRKNLDAANYKHIVLGFIFLKYISDTFTDFQGKLKANIANPESDIYLDPSLFEPSEFEQILSAELEERDYYTAENIFWVPTQARWENIKDNSKLNAGDELPWGGKFKNVSILLDDAFEAIEQENPKLKGVLQRIAGFGVPDEMLRGLTDLFSRTDFTRPMYNGEPVHLQAKDILGHVYEYFLGQFALAEGKKGGQYFTPKSIVTLIVEMLEPYSGRVYDPAMGSGGFFVQTDRFIQAHQGNRNAISVYGQESNPTTRKLAVMNMAIRGIPFDFGDKPEDTLLNPLHIDKKMDFVMANPPFNMKEWWSESLAGDPRWAYGTPPQGNANFAWLQHMIYHLSPKGKMALLLANGSMSSQTSGEGEIRKNIITADLVEAMIALPNQLFTNTQIPACIWIINKAKARKGEVLFINATQIGYMKDRVLRDFTVDDIAKISDTYHNWQKQDGYENIPAFCYSATLDEIAKNDFVLTAGRYVGAVTEEDDGVPFSDKMQELTACLNEQFKQERELEQQITENLKGLGF

SEQ ID NO: 3779 - protein, 294 aa, M.catarrhalis
YTNTHTLNAVKLIAGITAAFAGEDVNVAAGVAAEAVRWNGTAQIFYYNELEEIKNDIDGTYVKEQLQAITNISDDLAELLENVVYLKNTRGDFIVCFRHSGESCQPRSGQRYATQQEIRQGYIDVAIEIIPNRRLETSVKVVTKRGARTVSEAVIEKPTNNQSKPSHRAAVYIPRDQELRELFTATNPRVGVRIGNRTLLPESNSQGLVRVFRGASDAEVKQYFTELTGKPLPQPREITIGRNKGLLYAVKTENGSYNLRSVASSQSRTGLVWTIDIPKSATGTTKNPEIKFLR

SEQ ID NO: 3780 - protein, 502 aa, M.catarrhalis
KGYAMNQPTNQSTTQPSSIPLNCPNLLKQACLIDGEWVGADSGETIAVTNPFTGDVLGTIPSLSKQTVLNAVECADAAQESWANTTASERAKLLHAWADLIDTHKEDLALIMTYEQGKPITESQGEIDYANSFIRWFADEGKRIYGDVIPSTNQSLRYVVLKQPVGVCAAITPWNFPSAMIARKAERAIGAGCTMIIKPATETPFSALALGYLAKQAGILKGVLQIVTGKSSVVGEVLTKDPRIHKLSFTGSTEVGRVLMEQCASTIKKLSMELGGNAPFIVFDDADLEKAAEGLIASKYRNAGQTCVCANRIYVQSSVKDEFLAKFKQKVEVLKVGNGADEATDIGPLINQQALKKVQALLDDALNKGATLITGGVPHDASQLSFTPTVISDITDEMDLAHEEIFGPIAPIMTFEDENEVIHRANDTIYGLAAYFYTQNHARAWRVSEALEYGMVGQNTGLLSTEVAPFGGVKQSGFGREGSKYGIEEYITTKYWCMDISK

SEQ ID NO: 3781 - protein, 174 aa, M.catarrhalis
IMSYDMSGVEILDALCLGNITLAENLLKQHPQHNLLAVNSDKKNWLHKVTDSMNPDEPPPVTISYLINQGIPINAQDVYGMTPLHYAMRSKNADAAIALLEAGADPNIPNRDNVIPLAMIGMIPKRLDVLELMLKKGGNVHFYNGHYEVLQLLELFWSHDKDYIPVIEMMKQYA

SEQ ID NO: 3782 - protein, 224 aa, M.catarrhalis
IYKKIKGHGVMIIQEMLQLLTTRSEFFMRLFVEHLMICGIAASCAIVIGVGLGVLITEHQKFAPFVIQTSNIIYTIPSISLFGLLILVSGIGNTSAIIALVIYALLPMINGTRTGFLQIDTGLIEAAESFGMTRWQILRRIKLPLALPIILSAIRTMLVMTIALAGVASFIGAGGLGVAVYRGITTNSTAMTAVGSILIMLIAFLADFVLAYFEKSIKWRKSHA

SEQ ID NO: 3783 - protein, 417 aa, M.catarrhalis
IMTDITLNQSHKLTWRSFGPGILMASAAIGGSHLVASTQAGALYGWQLAIMIILANFFKYPFYRFGTEYAYSTGNSLVAGYAKISRIYLWAFFVLCIISGVISTGAVALLCAVILGQILPWELSTLELSCIVMVTSGILLVAGHYRLLDGLTKWIIALLTVATVAAVFIAAGKPSAISADFIPASPWNLAALGFIVALMGWMPAPLEFSAVTSVWTAKKIRTDYTNRFQGFVDFNVGYFTSAVLAIFFLALGVFVQYGTGTEIAMQGGAYVPQLINMYTETIGNWAKMLVATIAFLCMYGTVITCADGYGRTNSESLSLILTNSTKATEKYVVIWTVFTIVAGYGLIAFFLGQMAALLKFAMISAFVTAPIFAYLNYALVKKEGHLSTIMKWYALAGIVFLTGFTVLFLLQFFGMIG

SEQ ID NO: 3784 - protein, 107 aa, M.catarrhalis
YSTSTECKRAYCTKYQSLPLTERGVTDFNQLKDEFLHIKQTRLSLDDGQLRLGMTCIGTYIQSPDKVKLGIAVSLSNSEYDDKKVQIGDALVKLAQAIENRMGFGSM

SEQ ID NO: 3785 - protein, 176 aa, M.catarrhalis
NSSILYHSTKKFVNETFNNCPKCYCTHFVKAGLGNGKQRYKCKGYHHYFSVKQRSNQKSNGIKKQAIDTNSKQILGFVCGKTDTNTFKRLYQQLNTHNMQLFFSDYWKSYRQVILKPKHITSKAQTFTIEGYNSLIRHFIARFTRKSKCYSKSEKMIENTLNLLFAKWNGSLRYVF

SEQ ID NO: 3786 - protein, 72 aa, M.catarrhalis
YIKIYILYIKHKFLILYNIALNILEYKITQSASPVFAATITKELKLARSTTYNILQALSAKGRTAQSTNHYH

SEQ ID NO: 3787 - protein, 226 aa, M.catarrhalis
MMKILMVLTSHENLGDTGKKTGFWLEEFASPYYAFKDAGADITLASPAGGQPPLDPKSDEPDAQTEFTERFKQDAAAKEQLATTHKLADIKAADYDAVFYPGGHGPMWDLAVDEQSISLIQDFVKTDKPVAFVCHAPAALKNVKIDGEYFVKDKKVTGFSNSEEQAVGLLDVVPFLLEDVLKENGGKYEKVADWQSYVVEDGLLITGQNPASSEDTAKRLIQKLQA

SEQ ID NO: 3788 - protein, 165 aa, M.catarrhalis
RLPVSGVQAQRQIRSGQANIAGYTIDKNGRLHNNRGQFTSDPNNPRVSTNLIRPNLRAKLRRQVDANYIRLPNGNYQHKDTREIVISPTQYGHTYGREHRRLVLAAEQTGLTQTQFNDFINSHPDYFRLENVSDNMGHRNEKPGNGDLQDIINDINEFKRKRGIR

SEQ ID NO: 3789 - protein, 129 aa, M.catarrhalis
IFKVITMIYISEKVKKEMLETSKNLWLSALFSAVSSYCVGINFEQHKEIFFQLIKEALDADLIKFIPPNGIWYEGYDIWDVSSDEIVAYLRDNFPKDATDELDEDVNLYFYITAPAVLWRQDDGSYYGS

SEQ ID NO: 3790 - protein, 317 aa, M.catarrhalis
SCLLRFWLTLFWRILKNQSNGENLMLKKSVLLLMSVLLVACQSQDDKIRIATKPMTEQFIIAEMLAILIEQETGTTVEITKGIGGGTANIHPAMLKGEFDLYPEYTGTAWLYVLKNEPIFDQAVLLENLKKSYQDQYNFRWVGMYGFDNTFGLAVRSDYADANQIATFSQLAPVSPNLTFGAEYDFFERDDGYQALSDTYGYHFKNTKDLDIGLKYQALNNSQIDVVSISTTDGALANPNLKVLTDDKAFYTHYHAGTVVRQEALQKYPKLESALMKMDGLISEQEMAQLNDLVENQGHNERKVAQDFLRKKSLLAS

SEQ ID NO: 3791 - protein, 148 aa, M.catarrhalis
WQLLWQLNQFPNTQVTVGGDLIVKSCQDTYQYTHDQKQAGFSADVGFDGKPQSFSINGGKTDVDDSNTPAQAQKNKLINQAKLIAGITAAYAGEDVNVAAGVAAEAVENNNDATKSGKLLKKVSDETCEIIRDSISAGLIISIKRVQH

SEQ ID NO: 3792 - protein, 337 aa, M.catarrhalis
KKYPVFSKIGFICDSFRIYMDSGETLTFQALILTLQNYWASRGCVVLQPYDMEVGAGTFHTATFLRALTPERWNAAYVQPSRRPTDGRYGDNPNRLQHYYQFQVVLKPNPANIQELYLGSLKAIGIDTLTHDVRFVEDNWESPTLGAWGLGWEVWLNGMEVTQFTYFQQVGGIECFPVTGEITYGLERLAMYIQGVDSVYDLVWADGEFGRVTYGDVFHQNEVEQSAYNFEHADVAKLFELFDFYEEQADKLVAVNLPLPAYEMVLKASHAFNLLDARGAISVTERQRFILRVRTLARKVAISYTEARAKLGFPLADDAHKAEALEKWLPKEPKIIL

SEQ ID NO: 3793 - protein, 693 aa, M.catarrhalis
FMTTILFELGTEELPPKNLKTLRDALKNSVGTLLNDQNISFDDIHAFAAPRRLALTITGVGEFQPDRIETKKGPSVKAAFDDAGNLTRAGQGFLQGLNATGRNLSVKDLGRIADKKGEYIAYDLTIKGEKITDLMPNILQKALDDLPIAKRMRSGIDRHEFIRPVHWVVLMSDDVVIDATIQGHKTGNQSRGHRYHSPDFFAIDHADHYENLLKNHHVIADFDQRQADILAQVKTLADDVNGTAIMPQELLDEVTALVDLPVALRASFPERFLAVPQEALISTMQADQKYFCLTDQAGKLMPHFIFISNINSKDSAQIITGNEKVVRPRLSDAEFFFLQDQKQPLFELNHHLKTQIFQDKLGTLWEKSERIANLAAHIADQIGANTDAAYRAGLLSKCDLASRLVGEFPELQGIAGTYYARLNHEPDVVADAIEEQYLPKFSGDKLPATHVGVALALADRLDTLVGIFGIGEIPSGSKDPFSLRRASIGILRILIEKRLRVSLSHLVKQALMGYGDILENIDQTLTEVMEFINARYRAMYSEQGVLVDTIQAVQAVQTDVPMDFDERIQAVTAFRLLPQAAILAENNKRVANILAKAGTVQGDVTPQNLIEPAEQALYQAIESAKVSVQPLHNHGDYQGILTTLVSLSEPLTQFFDHVMVNADDETLKQNRLALLSQVRKLFLSVADIGLLQS

SEQ ID NO: 3794 - protein, 279 aa, M.catarrhalis
KLTYLFITHEYKDNMMTTQNNQQNGKVAIVTGSAAGLGNAIATRLAKDGFKVVLHDISEDNLKTAKDEFDKAGYESISVVGDASKKDDQIRLVDEAVKAFGQVDVFVNNAGVESVEPFLAIEEKEIDRVLGVNIKGVIFGTQAAAEQMKKQDGIGKIINACSIAGHESYEMLSLYSATKHAVRSFTHSTAKELAEHNIRVNAYCPGVADTPMWERIDAAFVEHKGYEPKQAWKEFTQGILVGRPQQPEDVANLVSFLASKDADYITGQTILTDGGMVFR

SEQ ID NO: 3795 - protein, 279 aa, M.catarrhalis
TKYQFTFVQFIEYPMSQVWQSVQLARHAKRPLFLDYVDSLFDEFDELHGDRAFADDRAIIGGLARFNGQPVLVVGQHRGRSTRERIAHNFGMANPEGYRKIIRLVQLAERFGLPVFTFIDTQGAYPGVGAEERGQAEAIAKSIAVFSSLKTPIIATVIGEGGSGGALAIGVADRVNMLENSIYSVISPEGCASILWKTAEKASDASEALKLNATNLYQLQLIDEIVSEGVGAHEAPEPVMAALKNLLTVQLAELHALPIDELLEQRYQRLMQFNLKVSL

SEQ ID NO: 3796 - protein, 254 aa, M.catarrhalis
SLYHFIMNHIDNSNTLSNLHKLADACLYDFRPPADKLRTHGFLGAGGDLTVSTLLHAYRSGAFPWFDEDEPICWWSPEIRCVITPNDFYPSKSLIRTAKKQPWTITTNADFEAVINACRAPRRDTFQTWIHDNMVLAYRQLFKIGAAASIEVWAGMPYDSELIGGLYGVSFGSIFCGESMFHRRNDASKIAFWALMHWANQYGIQLIDCQLENPHLRRLGANLMPRDEFLELLKHLVMTPVLGNFWQFNANILH

SEQ ID NO: 3797 - protein, 345 aa, M.catarrhalis
INHQRDCFMYDVVAIGNALVDTEFTLSDAALDATGLARGNMTLVDTNGQNMLFAALNEQNLKPAKQAGGGSAANSMVAFAALGGRAYYHCRVGGDDMGDFYLGDLANLGVATDATYAVQADGTTGSCVVLVTPDAERTMQTHLGTSSEINTDNINFQTLKDAKWLYLEGYLAMSPSATDALSQLYEHARKTGAKVAVSFADPAVVKFAKEGLSAILNRGVDAIFCNAEEAALFADADADPVNTLLKYSDLVVITNSDKPTTIACRIDDRIIEHHIDSCVVSQVIDTNGAGDNYAGAFLYGLSQNLDLPNCGRLAAAVAAAVVGQFGPRLSIAEYQTIKKRTVSLT

SEQ ID NO: 3798 - protein, 237 aa, M.catarrhalis
QITQKFGIIIQIYQKPSRMSLNPQSRSIKTPSVFNLPNNLTIARIVMIPLFVAIAYWPPALGIGVPAIPDNAIARLGMMGYSDSMLRHLILTLLFILAAVTDWLDGYLARRMNITSAFGRFLDPVADKLMVAAALIVLVQWHPNIVMATSAIVIISREIAVSALREWMAELGARTSVAVSYVGKLKTTFQMIAITVFLLNWQSLEMIGYVLMVIAVILTLWSMMIYLKAAWPYLKQP

SEQ ID NO: 3799 - protein, 76 aa, M.catarrhalis
TSYQQGVSPSLFLIGLGKLITDDILNKLLSALDELALPCYGKLYPACKGGREFLGFWLSLVLGNKTRFKLIGLPPY

SEQ ID NO: 3800 - protein, 448 aa, M.catarrhalis
VMTHSHNIRHTEHLIIGFGKAGKTLAQTLAKAGKEVILVEKSADMYGGTCINIGCIPSKKLAFLSHERDVSLSDAIARKNQLIAKLNQANFDKVNELDNATVITGEASFIDDKTVQVVTADDTLKITADHIHINTGAYNWQPPIDGLKDSKFAHDSTSIMQLTQLPKQLVIIGGGYIGLEFAFIFAGFGSVVTILETADTFLPKEDADIRQNLLGIMANKQITVKTKQQIKQVNDANNHAMVVTEDGELMADAILVATGRRANTQGLDLDKAGVILTDKGNITVNDRLQTSVPHIYAMGDVAGSPQFTYISLDDYRVVKSQVLGDGTYTTKGRTFAYAVFTNPPLANVGMTEQVAKEQGHAVKTAVLEAVNIPKAKILEQTDGLLKAVIDAKTDKILGVQLLCDNAHELINFMDLAIRQGLTYQEVRDYIFTHPTMSEALNELFAQFG

SEQ ID NO: 3801 - protein, 998 aa, M.catarrhalis
KLVKILDSFMTTLHSSFELIDKRSIEALDITVLTSRHRLTGATHYHLACDNSENALMIGFATQPMTSRGEAHILEHVVLCGSQKYPVRDPFFSMIKRSLNTFMNAMTASDWTVYPFASQNKKDFFNLLSVYLDAVFFPNIHPLDFAQEGVRVEINQDNQPEYHGIVFNEMKGAMSGEIDQLYYALMPHLFPTTTYHYNSGGDPAQIPKMTYEDLVAFHQTHYHPSNAIIMSFGNIAVDEIQAKIHDEALSHFDDIQKPAQGKKFTGVVEKPLSQPIQVYDTYSADSDDKQMTHHVLAWLLPTITDPRLRLSLRLMEGVLAEHSGSPLRAYLESHPLAVAPSPLLGLDDSHYQMVFYAGVRGSEPEHAEVLEKGILALLNQIADNPISQEVIETILHQIEIDQRHIGGDSMPYGLTLMLEAFSTAVHGGNPLDVWQIDEHLAWLKQQAGEPNWLQNLIRQYLIDNPHRVRLTLSADTKKAARLVDEENQALAALDATLSDDDKQNLLTQAAQLKARQAAPDDVSILPKVGLEDIPSEVAFTKGIKTTLSLDGETYPVHLYHTGTNGLYYYQVITPLTDKVADEVINNPLLPLYLTLLSEVGTNNYDARTFQAVQASHSSGVTARISQRTQLTDKESLSSYFVVATRALNRKLEAIELVSEVMNETVFSETDRIRELLQQKQSSWQARLASAGHAYAMQTASSQMSRQARIEYAYSGLPALAALKSFLASAQADDSLWDTLCHRLSELHHTLISLPKQVLLVCEEQVSSDLLDEISKHISTKTTLTPSQKVSQKLVFDTLDELLCQQDEPKTAWLISSNVYYNAAAYQATTSEHEDTPALMVLAPFLRNGYLHGAIREKGGAYGSGASFDSNAAAFRFYSYRDPHCAKTFEHFDKSIDWLLQTNHDTEQLHEAILGIIAGMDKPGSPAGEAVKSCFNELHHRDKAWQQNLRAKILAVSIDDLKYVAQKYLKNKPSHQAVLAPIEQELALIDMGFKIKKLS

SEQ ID NO: 3802 - protein, 396 aa, M.catarrhalis
IFVKIKIILKFRCNMINYTKTFAKRLLKNVKTMKNLQKTSKKQPFPIDLSKKSKRAKQSVQQSADFAITDFSRVNFLTVTNNQDGQRVDNFLLARLKGLPRSHLYKLIRSDEIRINGKRCKAHDKLYMGDVVRVAPIRLSVREAPIISEELAKGLLERIIFEDDGLIVLNKPHGMAVHGGSGESFGIIEAMRLAMGKKYLELIHRIDKDTSGLLLIAKKRSTLKILQEQFRKKTIQKRYLCLVMGHVQADEMVIDVPLLRYTLANGERRVKVAHLNEQKAGEYAKASLTKIKTLLRFKKDGCPVSLVLAMPATGRTHQIRVHMAHIGHALLGDDKYQNNPLAPKVGRLCLHAWQLGMTNDDGHTVTRPQNFVAPVADDMAQLLPKTAEWLPKTVSN

SEQ ID NO: 3803 - protein, 441 aa, M.catarrhalis
ILGKYAKLILTFYSPTKQGKFMFKEISLHQYDPELATQIDAETKRQEDHIELIASENYCSPAVMQAQGSTLTNKYAEGYPKKRYYGGCEHVDAIEQIAIDRAKELFGADYVNVQPHSGSSANSAVFLALLEPNDTVLGMSLAHGGHLTHGASVNFSGRNYHAVQYGLDTETGLIDYEEVARLAREHKPKMIIAGFSAYSQIIDWQKFRDIADEVGAYLMADMAHVAGLVATGIYPSPVQIADVTTTTTHKTLRGPRSGLILAKANEEIEKKLASAVFPGSQGGPLMHAIAAKAVCFKEAMSDDFQSYQKQVIINAKAMAEVIQSRGYEIVSGGTKNHLMLISLIKQGITGKEADKWLGDAHITVNKNSVPNDPKSPFVTSGIRIGTPAVTTRGFGEAEVRELAGWICDVLDARGDEAVLAATREKIAQICNKLPVYERNVA

SEQ ID NO: 3804 - protein, 1181 aa, M.catarrhalis
IFVNLIPMLLSLGILPIRNIMKRILINATHSEEIRVALCKDNHLYDFDLENRTREQKKANIYKGHITRVEPSLEAAFVEYGSARQGFLPLREIAPEYLNGNTHEDSIKQLIKEGDEIIVQVEKEERGNKGAALSSFISLAGRYLVLMPNNPKAGGISRQISGKVREEMKQIIAGLNLPKNMSVIVRTAGLGKGADDLQNDLDHLLDIWKSIQEQNKKRPSPCLVHQEAGVVTRAVRDYLRDDIGEVWIDSENAYDEAANFIKAVMPTQLSKLRKYTDYEPMFARFGIERQIETAYQREVRLPSGGSIVIDQTEALVAIDINSSKSTKGSDVAETAYHTNLEAADEIARQLRLRDMGGLIVIDFIDMNDPRHQKDVEKRLIEATRHDRARVQFSEISKFGLMQMSRQRLRPSLEESTGYICPRCHGNGMIRDLRSLSLSIMRQIEQIALKERMGEIQAEVPTDIAAFLLNEKRESLVYLEQDSGARITILPHAHLESPNFSLHFNPDGFAPSSYERIADTEEKENIDRGYEVNWQTDHEKSDSNRWQKPDNKPIKKNTTDSEPKPTKPEPQAVAWLSNLFAPKPQAKVAGSLGTADAALAIEALVNGGAVSLGAAGRMANIQAPSAEPTPRPQAEDKRHKKSRNAKKESGEETAAQAQPSEKTDKKTKKERDKEQYPKREAGSRRESRGEIVRGETLHKTEEKADKADKPIRADKPKSEKTEKLPHQKAANPKEVVLHVSSIKAAENNTQVIHLSLDGSKSTKPTKDETSSAKDDAKIAPKANSNQAIKAPKEPIPTKPKHEAEPITQSDESGEMSALHTVSATTGVEPKLAEKIQTLAKSMNKATNDPRVVQIALQQTQAINLNAITAGALILRVLGKSATGNFVNDFITAMTKMSTPAQFDFANFGYSPLDTATKNEFGKLTQATAQASAPQGRTEAIPRPITRRAANDPRGQHPEYIEATSPNNDQVSKTIAQHSNQASPDTFDHAVTPADTKHKESKIATDSSSDSDNSQLSKADDAVEHQTNDAIDATTLAAEQISDSIGDTVSKTMADISTVVSEAADDTAKMADLDTHNQVKPESGKDKKVSQIKEITADQKTERKTKANSYKDMIENVAGQLQPQVGILNLMATKPAKVSKPAKTRAPRKPSKKPTKVEVRKLSKPVEPSESSPAKSADDSANN

SEQ ID NO: 3805 - protein, 86 aa, M.catarrhalis
TMGKFMPRLIKLHRSKNHRMIAGVMGGIAEYLGWSPNMVRIAFVIISSLSAAVPGILIYLVLWLIMPNATPNSYATNLVQYDRKSL

SEQ ID NO: 3806 - protein, 149 aa, M.catarrhalis
LNSDVLITFSFNNFRINPLHQDTMMKHAVLLALSVATFGLSACSFNATAQNPTTTTAISQPPAKAVGVWIDVRSAEEYADGHLQGALNITPDQIASHIEAIEPNKNAPINLYCRSGRRAEVARKTLLEMGHTNVVNHGGYQDLYDKGYR

SEQ ID NO: 3807 - protein, 348 aa, M.catarrhalis
QFLDKTMHSSQQFDYLIFIGRFEPFHQGHHYVITQALAHARQVIVLIGSANSPRTIKNPFHPNERQAMILNSFDKKNRERIHCLGINDATYNDNKWLIEVQNAIVSITANTPNERIGIIGHDKDESSYYLALFPQYKTFMVKNFEYISATPIREAYFGDDSAKKQASFSQLTKACVEFLTAFEHTKAYHRLKQEYQHIQAYQAAWQTAPYPPNFITSDALIVQSGHILLIERGGEYGQGLYALPGGFVDTNEDFYQACLREVHEETNLDISLLKNSLITATLFDAPKRSQRARTVTMVYYFELPKQQTLPDVQAGDDANRAFWLPLSELNAVQMFEDHYGIICQLLKI

SEQ ID NO: 3808 - protein, 357 aa, M.catarrhalis
HTKDMIMQPDHLILIGDFAPLTLSMLADINHAAGLSKTLHIIIQTPNHAPLPCGRTPTLADAVRWVQMACQSFGFIKIHTFGSLALPDMSFDYRNNTQLTKHQFLAICQALNITAHTTMLGIKSSHKDTLHPFELTLPKYGHASNYDDELVQNNPLAYFHQLSAVCRYFYTQTVCIVGGESSGKTTLVQKLANYYGASIAPEMGRLYTHSHLGGSELALQYSDYASIAINHANAIETARTTASSAVTLIDTDFATTQAFCEIYEGRTHPLVAEFAKQMRLDFTIYLDNNVAWVADGMRRLGDDHQRSLFANKLLEILARYDIGHHIINDTDYHKRYLQALSLIDNHIFNHFTKIHDN

SEQ ID NO: 3809 - protein, 172 aa, M.catarrhalis
NCTLVPPIDDDFMPMDEILDHLPPKLADFVFTQGSLTARLEAHSKKPLKVEIIHQGYQPLTFAQKSQLGLPLNRPQMAWVRSVKLYGDADAWVLAKSIFPLSSLTGSLARLKALGATPIGYVLFKKRQQLPIKRHFYRYDGQIGRQTVYDINGRKILIDELFLAAFQASFDQ

SEQ ID NO: 3810 - protein, 541 aa, M.catarrhalis
QNRWIKAAICRKITPFIKNVIQGFAMQSAILDDDHRHQQIANAIHAAAISRDELLGAIDLGSNSFHLAIGRLDHGEVRKVASISEKVQLAAGLDDNNQLSKEVMQRGIECLHRFAQHITEVQPSRLRIVATNALRKAVNAAEFIQYANEILPKPIEIISGREEARLIYLGVSHSNASTDKRLVIDIGGGSTEFIIGQGFEPIEMESLQMGCVSYTKKFFGDGKITERAFDKAAKHTRSELLTIAKRYQKVGWDNAIGSSGTIKAARLVLAELGFGGESITIQSMQKLKKHLIKLGSVDKIDFDGVKAHRQAVFPAGVAQLLEIMQTLKIDELGYSDGALREGVMYDMLGRLNSEDVRDRSVAAMAQRYSVDTKQAGRVMARAARLFHHAKEALGLDDEDADLLRRTANLYEIGLAVGHSNYQRHSAYLLEYSDIAGFSQVGQAMMAQIARHHRRKLKADARETVENLGGCKLVYLCLILRLAAQSSQSRTTKAATLDLYSVTPDHWQVTVGEGLHKELIITQLEQDVAQFAKWGVRLEVAG

SEQ ID NO: 3811 - protein, 768 aa, M.catarrhalis
KKRCFAVKAQHRFYLKFQDIVSRDCFKVFWHIKYRPCPNISNHFKDKIMTTQRIIKGSLAIDKILFDFIENEALPIAKLDSDTYWRNFEQVVLELTPKNKALLAHREKLQAKIDDWHKNHVYELGAYKQFLSEIGYLEPEVADFTITTENVDEEIATMAGPQLVVPVRNARYCLNAANARWGSLYDALYGFDIIAETDGAEKGKGYNPVRGAKVIAFAKNFLDETFPLVDGSHADVISYAIKDGQLSANMGKSWSTLTENKVVGYNGVPDNPSEIILKNNGLHVIIQIDPHSIIGKDDKAGVKDILLESAVTTIQDLEDSVVAVDAEEKVEGYRNWLGLMKGDLSETLEKNGKTITRTLNADRTYTDLNGNTQTLHGRSLMLLRNVGHLMTNPAILVGGEEIFEGMMDALITPMLCAIDIRGENTLRNSRTGSMYIVKPKMHGSQEVAFAAELFSCAEKAIGLPKNSLKMGIMDEERRTSANLKNCIAQAYERTIFINTGFMDRTGDEIHTAMHAGAFVRKGEIKEQIWFHAYEKRNVLIGLNAGLRGKAQIGKGMWPKPDELADMYRTKIEHPQAGASCAWVPSPSGAVIHAIHYHKCNVTKRQEELARLAIPSLDDLLTIALATDTNWTAEQKRCELENNCQGILGYVVRWVDLGVGCSKVPDINDVGLMEDRATLRISSQHVANWLVHGIVTADEVWDALRRMAKVVDEQNASDPAYRPMSSDFDNNIAFQTAAELIFKGATEPSGYTEPLLHRARLKLKGYQGD

SEQ ID NO: 3812 - protein, 260 aa, M.catarrhalis
QLIRENLMKIDILDNITGFGKKDWTTSWVLLWFVCGFIALFTGFWTTTAHTHLDWFYFVISIIGLVCVVSLSFRKNITGNGLGMVATAGEVIVQGTSGAVGLMLAPLFNFFTHVYGVKYWSNHTGADGDMIPKSAGKYVWLITVCFIILGLLLFPTVNTWLANMGYVVVENDGSRFLGRIDFFWINVLAFVLSITAQTMMILRYSLNWWLWIVVNAVWLIINLMTGNTIFAIQTVIYQINAIVGLYGWYRSEQLARLQSP

SEQ ID NO: 3813 - protein, 408 aa, M.catarrhalis
VFVSISVDTLIIGAGASGLFCAFNTAAYGKSVLIIDHANKAGKKILMSGGGRCNFVNKQVEPCHFISQNPHFVKSALSKYQPEDFIDLVNRHHIAHQEREHGQLFCKNSAKDILSMLLNECHMAGVDIQLKTTVQDIQATDAHFLVTVKSQPDNRTKVIQAHALVIATGGLSIPTLGASGFGYQVAMQFGHQIIPTRAGLVPFTFTDKVGEMIKSLAGLSLDVIAYNDKASFDLPILFTHRGLSGPAILQLSNHWQAGEQITINLVPTQDVYQYLLDTKRIHPKQLLRTALAALLPKKLISAFERLFWQAYQNIELANLKDETMHHIGQQLNAWHLKPSGTEGYRVAEVTLGGVDTHDVSGKTMESRRQPNLYFIGEVLDVAGQLGGYNFTWAWASGYACAQSIGVRW

SEQ ID NO: 3814 - protein, 355 aa, M.catarrhalis
LFERWALLREGMMHCKIAVVCVLIMAGTPLVWANHTAKAAVDELAQPKVKTGMNAIKPDINTMGWIDKNHQRFQDWLQNSAVNIDGWFGENQSSKPAKASLQVMMDTTWNKYDGIKIKPRVRGRIKLPTLENRLSLVFGDDSLDYETRDGALSDDRKVMPNANDHRYDRRETRESNSSLALRWSKFRRNKDIDIDLGVRSNDVYIRAKAEKKWEMPHDITMRFEQMYRYGSHTEHTAVSTLEFTQPQSGHSDLVSRSQLHYTHKGEENLYWHSSLFQRHFVPVKHGKSELNYGLYVGGNIQDKKVYLNTYGPYVGYRQPVWRPWLFLQTDVSYYNSKHDARSHHTSIFGRAEVIF

SEQ ID NO: 3815 - protein, 213 aa, M.catarrhalis
IKLIKQKRVAMSEALTSNIKITEPAQEYLADLLAKQEEEGIGVRIFVEHAGTPRAECCMSYCHADEIDDQDLHIDYAKFTAHIDADSIPYLHDAVIDYNKDRFGGQLTFRAPNSKVPQVGENASIEERINYVLQSEINPNLASHGGSVDLLEVIEDEAGLTAVLKFGGGCQGCSAVDVTLRQGVEVQLKQQIPELTQVVDDTDHSISDHAYYK

SEQ ID NO: 3816 - protein, 164 aa, M.catarrhalis
YTKINQTTWQTQEKVMYQHVLLVTDLKDDTDLVAQKAKWILDLQPQAQLSVLHIVEETMLGFGYELIPASALHEHIDDERCQTARIRLADVLARNHLQAHHINIKTAISGRKGIVDYCQAHAVDLVVIGRHKRTGLSAWIAGATADSILPDIDSDLLVVQLTED

SEQ ID NO: 3817 - protein, 536 aa, M.catarrhalis
KELVMTYQSALEHVRSVKAKLGNYWDAIRPEDAARMVVQNRFKTGLDIAKYTASIMRRDMAEYDADNSKYTQSLGCWHGFIAQQKMIANKKYFGTTSKRYIYLSGWMVAALRSEFGPLPDQSMHEKTAVPKLIEEIYTFLRQADAKELNDLFRALQQAEQAGDEAKVKEIEAKIDNFETHVVPIIADIDAGFGNEEATYLLTKQMIEAGACAIQIENQVSDAKQCGHQAGKVTVPHEDFLAKINAVRYAFLELGVDEGVIVARTDSEGADLTQKIPVSREAGDLASKYISYLQTTEIDISEAKEDEILIKRNGKLHRPTRLPSGLYQFREGTQHERVVLDCVTSLQNGADMIWIETPTPDVAGIARFVNDIKKQVPDAKLVYNNSPSFNWTINFRQQAYDRWADEGRDLSGYDRDKLMDAQYDDSELAYDADEKIRTFQADAAREAGVFHHLITLPTYHTAALSTHELAKGYFGDEGMLAYVAGVQRKEIRDGVACVKHQAMAGSDIGDDHKEIFSGENALKAGDASKNTMNQFGG

SEQ ID NO: 3818 - protein, 187 aa, M.catarrhalis
FMTVHSVKHSVKKTKRFFLPMVMSLTAMMALTAYGNHLTSQPSSAKTIPTQTMEYHAMNTTHTTKTIASRYDFNDTVSRLQSAFKEQNMTIFATIDHQHAAQQVDLDMQPATVIVFGTPKAGTPLMKKDPHFALKLPLKVLVTETDGQVWVRFEDTHALIAGSQIGFDDVKDTLANAEKLIEKTVTQ

SEQ ID NO: 3819 - protein, 351 aa, M.catarrhalis
LGKTMKAPPNNAKDFEEFGTPQQADLPNDAIPFYGTQKYSDHPPSRLKLGYDIVMLILLFIDLILMIIDNILMSGFALSIANWLTISQAVTTYQTDHHLHISALGGFFTLFWIMDLLARWSLAIYQKTYYRWFFFPFVHWYEVLGVFPALRALRLLRAAVITKRLHRLGIQVIPKRWVDSAKFYYHLLLEELSDRVILTAIDNFRAQIARDGAGGAKVIHQTIERNRTQIELALLTLLRNELTPKLQSALLANHGEKLAIDIGQAVEKALTNTPELHKYLKLIPIADGMIESQIHTIGNQIGQNVTTAVNRHLFDDITLDTLCHRLPMVLPKLMPLVLRFRYSLPRLLKRC

SEQ ID NO: 3820 - protein, 100 aa, M.catarrhalis
FLGAFMTITTEDILDCANLSRLALDEKTAQNYAGNLDKILAMMDILDGVNTDNIKPLANIHEACNELRADIANSDIGRDGFQAVAPMVQDGLYLVPQVIE

SEQ ID NO: 3821 - protein, 496 aa, M.catarrhalis
KRHFMTDLHHLSVHELADGLKNKQFSSHELVEHFANRINRLDGQINSFITKDFDNALAQAELADKLRAKGDNRPLLGVPMAHKDNLCTKGVLTTAGSKMLYNFISPYDATVVDNIANSGFVSLGKLNMDEFAMGSDNESSYFGAVHNPWDTTRVPGGSSGGSAAAVAAGFVPVATGSDTGGSIRQPASFCGITGIKPTYGRVSRYGMIAYASSLDQAGAFGKSALDCAYLLAPMTGYDPKDATSISRPSEDYVADILATATDGKPLAGKKIGIAQAYFGAGLDDEVEKSIRAALATYEALGAKIVEVDITDPAITLATYYLLAPAEASSNLSRYDGVRFGYRCENPEDLHDLYTRSRSDGFGEEVQRRIIMGTYALSAGYFDAYYTKAQKVRRLIVDDFKKAFEKCDIIASPTAPTAAYKLGESLDPASIYLGDVYTIGVNLAGLPALSHPVGQANGLPVGLQLIGKHWAESELLKTAHIYQSHTDFHQAKADLVK

SEQ ID NO: 3822 - protein, 264 aa, M.catarrhalis
GIILMTQAVTLFGKMLTFSRLKVHTDDLTEIRKDLMQVLSNNPIASGLPIVIDSTVNLELDALIDMLWLMDVQPIGVVSGPLDNQARDLRLAIFPADGKRIERLPNTEDKSNPNQSGTVPAPNYDTDKPISAAAVSTQQGSTLSTAQDNHRSLVSGIHTHMLRSGQSLQHLGGDLTVIGGVNDGAEAITDNSLHIYGRGLGRLVAGATGDKEARIFCQKFNPSLVSVAGTYCLRDAIPSEMIDQAVQVTYDEAQGLVFTLLNQL

SEQ ID NO: 3823 - protein, 137 aa, M.catarrhalis
PFDQAGQKADNAFVVYYLKPIMNDIKTLPIVLASTSPRRQELLLAAGVKFVVNAVEIDESWQAKEAPTDYINRMVLTKAQQAALNSHLPDKCLLITADTIGVIDDLVLTKPKDQADAYRMWQMLSDTSHEMYLKSSH

SEQ ID NO: 3824 - protein, 70 aa, M.catarrhalis
VHGQMLLTPVLTPLRVVIFVPYPNIKCEEKRACIALIYLGAVCLYNMVSCISNIQDTLYRYLSCHYACNT

SEQ ID NO: 3825 - protein, 203 aa, M.catarrhalis
SRVKFGDQTKLNDQTKLTAKRKPNCIGANMKHQKLKAQPLIFSLCLGLWLTGCGSDNSTSTPAPVNETQPSTPTSEPAPAQPEPSVETQATPETAETQDAPEVAEVTEPVDVTTSHAPVEAASIEVGKALYEKTCKVCHDAGLLEAPKITDKAEWQKRLDEKGLETLQAHSAKGFNKMPAQAIGDVAESEVYAAVNYILEQAK

SEQ ID NO: 3826 - protein, 319 aa, M.catarrhalis
LMINSRKMLPLFKKLHTKQPKLAQKLSLLTNASAITANSLALGVPVIGAGLAKTLTRSKLADQTIITAANRWIHTNNLLIDKVLPHKDWRIFLPKNLNPNGKYLLICNHQSWVDTSIIQYISEGRLPITRFFAKHELIYIPVVGQAFYFLDFPMMKRHTKAQIAKNPQLARRDLDEALRACQSLKNKPFVLLNYLEGTRFTAEKHTKQSSPYKHLLRPKAGGFALALSSLGDEIDGILDMTLVYPDGAPKYSDLWSGKLTRLSVDIEFISPNDELLTALKHGEYDTNQTIKHALYAWLDEIWQAKDKKISQRLAEFHQS

SEQ ID NO: 3827 - protein, 231 aa, M.catarrhalis
PKAKGVFMKIKALGVVLLASSMALAGCANTGTTGNGTGFGGANVNKAVIGAVAGALGGTAISKATGGEKTGRDAILGAAVGAAAGAYMERQAKQIEQQMQGTGVTVTHDTDTGNINLTMPGNITFAHDDDTLNSAFLGRLNQLANTMNQYHETTIVIVGHTDSTGQAAYNQELSERRADSVRYYLINQGVDPYRIQTVGYGMRQPIASNATKAGRAQNRRVELMILAPQGM

SEQ ID NO: 3828 - protein, 86 aa, M.catarrhalis
SIAWVNKEVMHVFYPNQNQKPTKTSTTGFFNEVLKKPTFVKIYFNHILWWTFVYGLIKTDEIPPVFDLFFYLWLAKFHQAKHKVRV

SEQ ID NO: 3829 - protein, 181 aa, M.catarrhalis
LYHRCLLYLILRSAIVAKIVVVTSGKGGVGKTTTSASFGAGLAKRGFKTVIIDFDVGLRNLDLIMGCENRIVYDFVDVISGNAKLAQALVKDKQFENLYILPASQTRDKDALTDEGVAKVMKELADDMKFDFIICDSPAGIERGAQLAMYHADEALIVTNPEVSSVRDSDRIIGILQSRTK

SEQ ID NO: 3830 - protein, 317 aa, M.catarrhalis
KEIMMQRRHFLQKTLLALPIIFSGNLLTGCKTNLSDDYLPDDKITNNPNLLQNKLKEILPIWENKFNAKIGMTIIADNGELSSHRGNEYFPVNSTIKAFIASHILLLVDKEKLDLNEKIIIKESDLIEYSPVCKKYFDENKPISISELCEATITLSDNGSANILLDKIGGLTAFNQFLKEIGADMVLANNEPLLNRSHYGETSDTAKPIPYTKSLKALIVGNILSNQSKEQLITWLINDKVADNLLRKYLPKNWRIGDKTGTGSESKNIIAVIWNENNKPYFISLFITQPHDGKSLDFKNQKDEIMAQIGKEIYPFL

SEQ ID NO: 3831 - protein, 72 aa, M.catarrhalis
VVPIRFFVKNDGVASLSPFIVWDKFIIVWDKFIIHPNPKITSPNPPLPDENRYGFGKCERFLTARFPPNVCR

SEQ ID NO: 3832 - protein, 494 aa, M.catarrhalis
IEKFMTQQAPLIDGYEVVIGIEIHCQLNTDSKIFSNAPTVFGQEPNTQATIVDLGFPGALPVLNAGVIERALKFGMGVNAKLGTYNTFDRKNYFYPDLPKGYQITQMANPIVGEGYIDILVNAGQKDEYTKRIGITRAHLEEDAGKSVHDAVPQMTGVDLNRAGTPLIEIVSEPDMRSVDEAVAYVKTIHELVTWLGISDAIMAEGSFRADINVSVHKPNTPFGTRCELKNLNSFRFIHRAIKSEIERQIDVIEDGGKVVQATRLYDPERDETRAMRTKEEANDYRYFPDPDLLPVIISDETLAKVCADMPELPSVRKERFVSEFGLTAYDANVLNGSRELSDYFLQVLDIIGKNNAKIAANWVMGELSGSLNKNELTIDQSPISAKRLAGLIVRILDDTISGKIAKEVFGHLWESDKSADEIITEKGLKQETDTGAIEAIIVDVLANNQAMVDEYKGGKEKAFNGLVGQVMKASRGKANPAQVNALLKQMIGA

SEQ ID NO: 3833 - protein, 716 aa, M.catarrhalis
YTLTKGKSPMDTDIILKNTPLDARLQLIDFNKATPQTLKNLIQTVLDDANETLTDIESASLPTNAKEAFEKIQKFNAISEKLDRYFSVLSHLNSVASNDAVRQTHHEVLPKISELGTRIGQSVALFSLYQLVDTQFDQLPSQYQNTAQKRAIEKSLQSFRLSGVALDADKKAQFADIQSKLSLASAKFADNVMDATRHFVRPLRPDELSGISENGLALLKSAAETYRAKHPKATLETEYVATLDMPMYLAVMQFADNRTLREELYHAYNTRASDQSPDTTEFDNAQIMVDIINLRTQKAKLLDMQDYSELSLATKMANTSDEIEKFLLSLSHAAKPQAYAEYQELKDYAQSLGLDELKPWDVAYVSEKIRQTKFSLTSDELRPYFPLPVVLDGLFEICQRLFGVKISVTQKQNYVAWHEDVLFCVIHDSDSHELLGGLYLDLFARAGKQGGAWLDGFQSRQVYGDELRLPVGFVIGNFAPPIGDKPSLLSFDEANTLFHEFGHALHHVLTTVDVADVSGISGVEWDAVELPSQFMENFAITDEGLRLISRHVETGDALPNDKKDALIATKNFQTGLQTLRQMELGLFDLRLHTAKMVNFGQITYADILSVADAVRDEVAVILPASYQRFGNGFSHIFAGGYASGYYSYIWAEVLSADAFGKFEEDGIFNPATGRAFRDEILARGSSRDAQDNYVAFRGRKATQEALLRHRGLINQA

SEQ ID NO: 3834 - protein, 275 aa, M.catarrhalis
SSIYHHRATIAIIKINSTHISIKYHAMKSITITSYNIHKGMSPTNRLVRLMGMKDALLKTNPDILCLQEVQGQNLKRTIDFAEFPDGGQHEWFGEFLGIASSYGKNAEYEHGHHGNAVLSRHPLDPKHNLNITVNRLEKRGVLHCEVHPDGWRRPVVVLCCHLNLLHRDRIKQYQAIRDYIVTLPADASLILAGDFNDWSKKSCQALSSLGLSEVFLQVHGEYPATFPAKMPVLSLDRIYVRRLKVHNAMVHGGVPWSNLSDHLPISACVSEMDE

SEQ ID NO: 3835 - protein, 269 aa, M.catarrhalis
VLCHWGRQYLHTGYVTRTNTYTPLETLGKIASAWIILPLKDCMPVAIIALPASSDVRKKKNGQEVEGFGASVSYLHPLDDHQTVRVALGYSDSRQNAKTTGRDSNFYATKSQGAAASVEYRNNKLLLAADIGQKNEQINGTVTDKSKGNYMGVKVGYEITPRLTMTAGFGKKVAERTQKSGAALIHAYQKDLCVADANDSCHNFVQAYETALFDKIDSKRSYVRADYYLRENVRLYGRIDDEKITNQLGNKDFSKLHNTGYRAGVSFIF

SEQ ID NO: 3836 - protein, 83 aa, M.catarrhalis
LIKHNHMRYQSNRPKRQFLAGVVCPTCKKIDTIVQVQVFEPDYDEYIECIECGHHEHRPTPDELTTIQEHAAQADGVGIVKFR

SEQ ID NO: 3837 - protein, 923 aa, M.catarrhalis
LKFNSMAWLITFLTKHANFALLWSTETIMKLNKLAAIISAGISCAYLTQCTSVHQMATFDTKTIDNEAALQDTKPPTNGVYTYPVTRIHQDSTDYFLSGEYGRSADHVRSEGEFGDSSAYPRPDDGVSRYFGEKIVDKFRWLENVDDMNKDYTQETDEDRDRNLIGSLLEDDVKDGLFDNRTRKDLQTVKPKQSSEVNDWVNAQNEVTNQYFDANPIYEQVKNNINALMSYRYSYRKENKDGVGSLELYRHEDGYIRLELTDTDGNKRTLFNERELSEDGNTVLPWPDIYVSDKGSYVAYVTAPGNNDTDTRGRTDLHVIDIKTGKAAIEPIQNADNNSIIWLDDKSFLYIQGSQIKRHEVGSKKWVDPIEVTWGEIDGAGPTDMWYSDDETRRYLVIEAYKKAPTSFIKDTKTNKVYRIHSEKFFNDFFYHAPDYTHAPLASLVHFDDKTLDVYFISGEKNIKGDIFKMNLNNPKKREIVVAIPDEYDETLEAIYHPEAGGHFLIKYLKDGAHKLILTDTTGKIVKDLTPDIPGNADDLTSYVAEDDNKDGDKKAKDKEVADEDDQTPDESYVSFRFNAIIKPRTVYKYSPSKGEFIDVRRRDLIPFDENLYESKQILYTSKDGTKVPMNINYKKGIKLDGKNPTVLYGYGGFGATENLAFHKSKAAWLEHGGVWATAFIRGGSEYGHTWHKDGRLLNKMNVFDDFAAAADYLAQSGYADSNHLAISGASNGGLLVGASMVLHPEKFRVAIPAAGVLDMLRYNDNFHTQYWAGEYGLPYDSVAQYKLLKSYSPYHNVKAGVCYPSTLVMTSKRDDRVTPSHSYKFVAALQDKQVCANPTFLYAAEQFGHWANTYQEQKNDYSLFTSFALNEMNIKHVPDLTHRHDADFYKTDKWREEEAKEHAKQIKKLQQRIDKLNETKDK

SEQ ID NO: 3838 - protein, 124 aa, M.catarrhalis
GYFMKPSIIKNPLKLLTAMILLNAMPSHAIYNLYKSGDFSFDVHGEINTYGQKNSQKYTYLYPETGWASVNNDYEAITKGAYEQRSDRRVRLGQDTGASWTEFRASRKLRDGWRVSGAIGFGLL

SEQ ID NO: 3839 - protein, 212 aa, M.catarrhalis
NQSITKGVMMQKWVLASNNQGKLAEFQALFDDADLGVHIITQGSLGIGDVSEDGKSFIENAIIKARHAAKVSGLPAVADDSGLCVPILGNAPGIFSARYAGRHGDDAANNTKLLEQLKPYRSRAPIDAFFVCVLAYVRHGDDPMPLIAIGKWHGEILNEPVGEHGFGYDPLFYIPKLKKSSAQLDRAAKNAISHRASALQDLLRQLKETWLV

SEQ ID NO: 3840 - protein, 410 aa, M.catarrhalis
KEQLLMKKTSTQLGLLAVSVSLIMASLPAHPPYLARNLTHGLKFGISGSVNPSLSVNSSTFTYLGDSSVYGNNATLERMLQDQDRQDSDERARLNGFGGASVYLGAQKYLTRDITLFGNVGLYAPASKGQRAAYGYGVNLATKYGSIGINTDNEFSAGAGTPSGIYNLVDGSNEYSTAISVSTSYIPKFKFSAYHALPGSPDTRSVSSHENYYIQKAQGLSASYSHPISPNQTLSVGTAYSKSQRHKDFFSDTAYNNKTASTVGLSYRQGDWSISGNVGQAKENLHGAIIDDITTKAFGTKISYKVTPRISVSGTYGQKTTDKNTKPNKRLDIPNIIAQRGGNISSRVHESWFFDKTKQKTYGLSASYYIYGGISISASMNQTRTTNFTEEGAYSERKNNSYRISTGFSF
